US010147505B2

(12) United States Patent
Huentelman et al.

(10) Patent No.: US 10,147,505 B2
(45) Date of Patent: Dec. 4, 2018

(54) METHODS OF ASSESSING A RISK OF DEVELOPING NECROTIZING MENINGOENCEPHALITIS

(71) Applicants: The Translational Genomics Research Institute, Phoenix, AZ (US); University of Georgia Research Foundation, Inc., Athens, GA (US)

(72) Inventors: Matthew Huentelman, Phoenix, AZ (US); Scott Schatzberg, Algodones, NM (US); Renee Barber, Athens, GA (US)

(73) Assignees: The Translational Genomics Research Institute, Phoenix, AZ (US); University of Georgia Research Foundation, Inc., Athens, GA (US)

(*) Notice: Subject to any disclaimer, the term of this patent is extended or adjusted under 35 U.S.C. 154(b) by 52 days.

(21) Appl. No.: 14/713,134

(22) Filed: May 15, 2015

(65) Prior Publication Data

US 2015/0347703 A1 Dec. 3, 2015

Related U.S. Application Data

(63) Continuation-in-part of application No. 13/905,109, filed on May 29, 2013, now abandoned, and a continuation-in-part of application No. 13/698,907, filed as application No. PCT/US2011/037262 on May 19, 2011, now abandoned.

(60) Provisional application No. 61/993,399, filed on May 15, 2014, provisional application No. 61/652,732, filed on May 29, 2012, provisional application No. 61/346,309, filed on May 19, 2010.

(51) Int. Cl.
| | | |
|---|---|---|
| *C07H 21/04* | (2006.01) | |
| *C12Q 1/68* | (2018.01) | |
| *G16H 50/30* | (2018.01) | |
| *C12Q 1/6883* | (2018.01) | |
| *A01K 67/02* | (2006.01) | |

(52) U.S. Cl.
CPC .......... *G16H 50/30* (2018.01); *C12Q 1/6883* (2013.01); *A01K 67/02* (2013.01); *C12Q 2600/106* (2013.01); *C12Q 2600/118* (2013.01); *C12Q 2600/124* (2013.01); *C12Q 2600/156* (2013.01); *C12Q 2600/172* (2013.01)

(58) Field of Classification Search
CPC .................. C12Q 1/6883; C12Q 2600/156
USPC ............................................. 506/2
See application file for complete search history.

(56) References Cited

U.S. PATENT DOCUMENTS 5,474,796 A 12/1995 Brennan
2013/0157873 A1 6/2013 Huentelman et al.

OTHER PUBLICATIONS

Illumina CanineHD BeadChip Data Sheet, Nov. 2009, pp. 1-4.*
Pedersen et al., "Dog leukocyte antigen class II-associated genetic risk testing for immune disorders of dogs: simplified approaches using pug dog necrotizing meningoencephalitis as a model," (J. Vet Diag. Invest. vol. 23, pp. 68-76, EDAT, Jan. 11, 2011).
Greer et al., "Necrotizing meningoencephalitis of pug dogs associates with dog leukocyte antigen class II and resembles acute variant forms of multiple sclerosis," (Tissue Antigens, vol. 76, pp. 110-118, 2010).
Safra et al. "Expanded dog leukocyte antigen (DLA) single nucleotide polymorphism (SNP) genotyping reveals spurious class II associations." (Veterinary Journal, vol. 189, pp. 220-226, 2011).
Barber et al. "Identification of risk loci for necrotizing meningoencephalitis in pug dogs," The Am. Genetic Association, J. of Heredity, vol. 102, S1, pp. S40-S46, EDAT: Aug. 24, 2011).
Smith et al, "Random prime labeling of DNA," (Methods in Molecular Biology, vol. 18, pp. 445-447, 1993).
Abitbol et al, "A canine arylsulfatase G (ARSG) mutation leading to a sulfatase deficiency is associated with neuronal ceroid lipofuscinosis," (PNAS, vol. 107, No. 33, pp. 14775-14780, Aug. 17, 2010).
Tacher et al. "Olfactory receptor sequence polymorphism within and between breeds of dogs," (J. of Heredity, vol. 96, No. 7, pp. 812-816, 2005).
Rothstein et al. "Chronic inhibition of superoxide dismutase produces apoptotic death of spinal neurons." (1994) PNAS USA 91: pp. 4155-4159.
NEB Catalog (1996/1997), pp. 29-32.

* cited by examiner

*Primary Examiner* — Jeanine A Goldberg
(74) *Attorney, Agent, or Firm* — The Noblitt Group, PLLC

(57) ABSTRACT

The present invention provides method of classifying a subject into a necrotizing meningoencephalitis (NME) disease risk group. The method may include assessing the presence of one or more marker (e.g., SNPs or risk loci) in a sample from the subject. For example, detection of the presence of one or more markers that are associated with an increased risk of NME can indicate that the subject should be classified into a risk group.

9 Claims, 13 Drawing Sheets

Specification includes a Sequence Listing.

FIG. 1

| Canine SNP | Chr | Pos | $A_R$ | $A_{NR}$ |
|---|---|---|---|---|
| BICF2P178662 | 12 | 5166878 | A | G |
| BICF2S23225431 | 12 | 5217389 | G | A |
| BICF2P22942 | 12 | 5227499 | G | A |
| BICF2P194998 | 12 | 5275229 | A | T |
| rs8856588 | 12 | 5622709 | C | A |
| BICF2P574765 | 12 | 5710832 | A | G |
| BICF2P1186632 | 12 | 5734305 | A | G |
| BICF2P1185629 | 12 | 5791672 | G | A |
| BICF2P540937 | 12 | 5829667 | A | G |
| rs9189886 | 12 | 5843592 | G | C |
| rs9006653 | 12 | 5916360 | A | G |
| BICF2P1200278 | 12 | 5931001 | G | A |
| rs9125534 | 12 | 5935549 | A | G |
| BICF2S23322760 | 12 | 5992526 | A | G |
| rs8760645 | 12 | 6024841 | T | A |
| rs9245050 | 12 | 6028685 | G | A |
| BICF2P863589 | 12 | 6059850 | A | G |
| BICF2P1115728 | 12 | 6064245 | C | A |
| BICF2P1254053 | 12 | 6149213 | G | A |
| BICF2P402427 | 12 | 6160615 | A | C |
| rs8694179 | 12 | 6164202 | A | G |
| BICF2P459960 | 12 | 6184107 | G | A |
| BICF2S22951431 | 12 | 6197313 | A | C |
| BICF2P1261424 | 12 | 6200280 | G | A |
| rs9120943 | 12 | 6218850 | A | G |
| rs9077055 | 12 | 6238545 | A | G |
| rs8677516 | 12 | 6257019 | G | A |
| BICF2P608380 | 12 | 6289014 | G | A |
| rs9132539 | 12 | 6299459 | A | G |
| BICF2P1340012 | 12 | 6311277 | C | A |
| BICF2P1211546 | 12 | 6320910 | A | G |
| BICF2P738783 | 12 | 6342204 | A | C |
| BICF2P1313789 | 12 | 6653816 | A | G |
| BICF2P639740 | 12 | 6686088 | G | A |
| BICF2P535495 | 12 | 6793393 | A | G |
| BICF2P1380652 | 12 | 6809061 | A | G |
| rs8957837 | 12 | 8822596 | C | G |
| BICF2P1462329 | 12 | 6832252 | A | G |

FIG. 2

| Canine SNP | Chr | Pos | $A_R$ | $A_{NR}$ |
|---|---|---|---|---|
| BICF2S23516667 | 8 | 31971609 | A | G |

METHODS OF ASSESSING A RISK OF DEVELOPING NECROTIZING MENINGOENCEPHALITIS

CROSS-REFERENCES TO RELATED APPLICATIONS

This application is claims the benefit of U.S. Provisional Patent Application No. 61/993,399, filed on May 15, 2014, and is a Continuation-in-Part of U.S. patent application Ser. No. 13/905,109, filed on May 29, 2013, which claims the benefit of U.S. Provisional Patent Application 61/652,732, filed on May 29, 2012, and this application is a Continuation-in-Part of U.S. patent application Ser. No. 13/698,907, which was the National Stage of International Application No. PCT/US11/37262, filed on Mar. 8, 2013, which claims the benefit of U.S. Provisional Patent Application 61/346,309, filed on May 19, 2010, and incorporates the disclosure of each application herein by reference in their entirety.

BACKGROUND OF THE INVENTION

Necrotizing meningoencephalitis (NME) is a non-suppurative inflammatory disorder of the canine central nervous system. Overrepresented in Pug dogs, NME also occurs in other small breeds including the Maltese and Chihuahua. The etiology of NME is unknown but non-Mendelian inheritance has been demonstrated in Pug dogs, suggesting a role for genetic risk factors in the development of disease.

Necrotizing meningoencephalitis (NME) is an idiopathic inflammatory disorder of the central nervous system (CNS) that primarily affects young to middle aged toy breed dogs. NME has known non-Mendelian inheritance that shares clinical similarities with atypical variants of multiple sclerosis in humans. Inflammation in NME is characterized by mixed mononuclear cell infiltrates within the cerebral hemispheres and cortical leptomeninges with common clinical signs including seizures, depression, behavior change, circling and visual deficits. Similar to severe non-prototypical forms of multiple sclerosis (MS) such as Marburg variant, NME is overrepresented in females, is rapidly progressive, and often carries a grave prognosis despite aggressive immunosuppressive treatment.

NME initially was identified in Pug dogs in the late 1960s and is known to have a strong familial association in this breed. Purebred dog populations provide a unique opportunity for mapping genetic traits and recent technological developments have made it possible to leverage dogs as a model for the study of human genetic disease. Dogs and humans share similar physiology with over half of the known canine diseases having a similar phenotype to analogous human diseases. An evaluation of canine NME, a disorder having clinical similarities to atypical, fulminant variants of MS in humans, is needed for identifying at risk and affected dogs, allowing development of targeted therapy and identifying similar genetic factors that are associated with the development of rapidly progressive MS in people.

Whether it is a human population or a canine population, the standard for measuring genetic variation among individuals in a population is the haplotype, which is the ordered combination of polymorphisms in the sequence of each form of a gene that exists in the population. Because haplotypes represent the variation across each form of a gene, they provide a more accurate and reliable measurement of genetic variation than individual polymorphisms. For example, while specific variations in gene sequences have been associated with a particular phenotype such as disease susceptibility (Roses A D supra; Ulbrecht M et al. 2000 Am J Respir Crit Care Med 161: 469-74) and drug response (Wolfe C R et. al. 2000 BMJ 320:987-90; Dahl B S 1997 Acta. Psychiatr. Scand. 96 (Suppl 391): 14-21), in many other cases an individual polymorphism may be found in a variety of genomic backgrounds, i.e., different haplotypes, and therefore shows no definitive coupling between the polymorphism and the causative site for the phenotype (Clark A G et al. 1998 Am J Hum Genet 63:595-612; Ulbrecht M et al. 2000 supra; Drysdale et al. 2000 PNAS 97:10483-10488). Thus, there is an unmet need for information on what haplotypes exist in the dog population that are associated with NME. Since canine NME is a disorder having clinical similarities to MS in humans, canine NME haplotype information would be useful in improving the efficiency and output of NME and MS diagnosis, prognosis, and the several steps in the drug discovery and development process, including target validation, identifying lead compounds, and early phase clinical trials of drugs for MS.

BRIEF SUMMARY OF THE INVENTION

The present technology may provide a test that classifies a subject into an NME disease risk group. The test may predict whether or not a subject will develop NME. The test may use methods involving receiving a sample from a subject, isolating nucleic acid from the sample, detecting one or more of the markers listed in Table 2 and classifying the subject into a cohort based upon the presence or absence of the marker. The marker may be directed directly such as by Sanger sequencing, pyrosequencing, SOLID sequencing, massively parallel sequencing, barcoded DNA sequencing, PCR, real-time PCR, quantitative PCR, microarray analysis of genomic DNA, restriction fragment length polymorphism analysis, allele specific ligation, and comparative genomic hybridization. Alternatively, the marker may be directed indirectly such as by microarray analysis of RNA, RNA in situ hybridization, RNAse protection assay, Northern blot, reverse transcription PCR, quantitative PCR, quantitative reverse transcription PCR, quantitative real-time reverse transcription PCR, reverse transcriptase treatment followed by direct sequencing, flow cytometry, immunohistochemistry, ELISA, Western Blot, immunoaffinity chromatography, HPLC, mass spectrometry, protein microarray analysis, PAGE analysis, isoelectric focusing, and 2D gel electrophoresis. The marker may be a marker that is associated with a high risk of developing NME and the subject is classified into a risk group comprising subjects with a high risk of developing NME if the marker is detected in the sample. The subject may be any animal including a dog such as a Pug Dog, Chihuahua, Maltese Terrier, West Highland White Terrier, Yorkshire Terrier, French Bulldog, and Pekingese.

Various embodiments of the present technology may be implemented through the use of kits comprising a first probe capable of detecting a first SNP selected from the group listed in Table 2, a second probe capable of detecting a second SNP selected from Table 2; and wherein the probes are associated with a microarray of 1000 or fewer elements. The first probe may be capable of detecting a SNP associated with a higher risk of developing NME, or the second probe may be capable of detecting a SNP associated with a lower risk of developing NME.

BRIEF DESCRIPTION OF THE FIGURES

FIG. 1 depicts the SNPs in DLA class II region on Chromosome 12, with alternative base as listed for $A_R$, the allele associated with NME risk, and $A_{NR}$, the non-risk allele;

FIG. 2 depicts the SNP in STYX region on Chromosome 8, with alternative base as listed for $A_R$, the allele associated with NME risk, and $A_{NR}$, the non-risk allele;

DETAILED DESCRIPTION OF THE INVENTION

Figure 3:
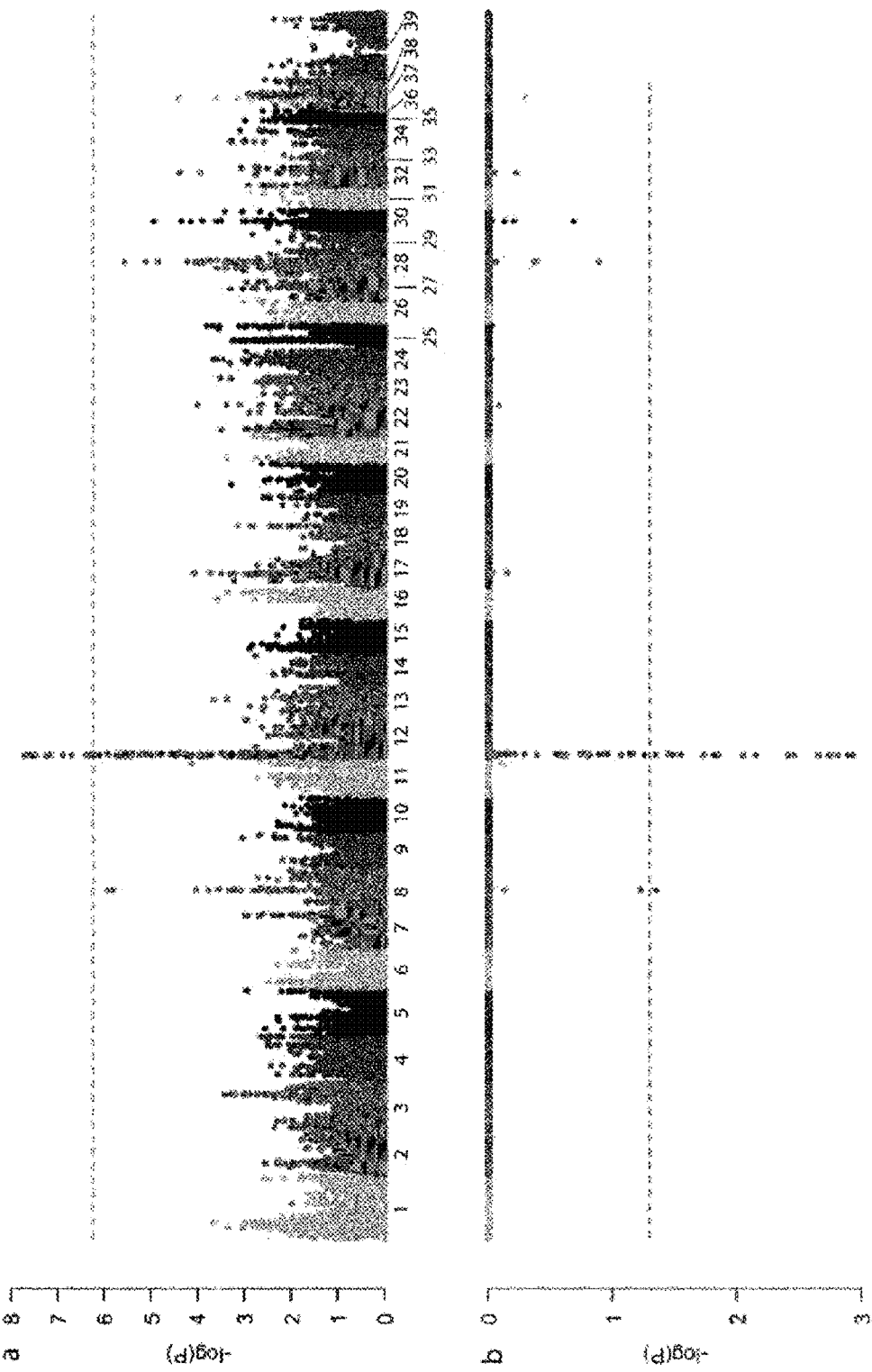
FIG. 3 depicts the genome-wide association results for 28 NME cases and 45 controls. (a) Fisher's exact tests were performed to compare SNP allele frequencies and negative log P values were plotted across the genome. The horizontal dotted line represents the threshold for significant association after Bonferroni correction of $-\log(P)>6.24$ with a strong peak on chromosome 12 maintaining genome-wide significance. (b) MaxT 100,000 permutation testing was performed and negative log P values were plotted across the genome. The horizontal dotted line represents the threshold for significant association after permutation testing of $-\log(P)>1.3$ with one SNP on chromosome 8 maintaining permuted significance.

The disclosure provides a method of assigning a subject to a necrotizing meningoencephalitis (NME) risk group in order to assess the likelihood of the subject being afflicted with the disease. This method can be employed to assess the risk at early stages of disease progression. The method includes providing a biological sample from the subject, detecting a marker in a biological sample, which can be a haplotype associated with NME and assigning the subject to the NME risk group based upon the presence or absence of the haplotype. The method involves directly or indirectly detecting the presence or absence of the marker. Multiple markers disclosed herein may be used in combination to improve the accuracy, including two or more, three or more, four or more, five or more, or ten or more of the markers may be used.

A haplotype refers to a segment of genomic DNA that is characterized by a specific combination of genetic markers (or alleles) arranged along the segment. A marker refers to a sequence characteristic of a particular allele. Detection of the disease also includes detection of the haplotype by any SNPs (single nucleotide polymorphisms) or other types of markers within the haplotype, but also indirectly through SNPs/markers outside the haplotype and leveraging linkage disequilibrium to identify carriers of the haplotype. Examining haplotypes rather than individual SNPs gives much stronger signal in detecting disease association. In addition, haplotypes can represent a combined effect of several sites along the same chromosome that cannot be detected when these sites are tested one by one. In the present technology, in addition to determining a patient's relative risk for NME, the diagnosis may include prescribing therapeutic regimens to treat, prevent or delay onset of NME.

A haplotype may be any combination of one or more closely linked alleles inherited as a unit with little genetic shuffling across generations. An allele includes any form of a particular nucleic acid that may be recognized as a form of the particular nucleic acid on account of its location, sequence, polymorphism, epigenetic modification or any other characteristic that may identify it as being a form of the particular gene. Alleles include but need not be limited to forms of a gene that include point mutations, silent mutations, deletions, frameshift mutations, single nucleotide polymorphisms (SNPs), inversions, translocations, heterochromatic insertions, and differentially methylated sequences relative to a reference gene sequence, whether alone or in combination. The presence or absence of an allele may be detected through the use of any process through which a specific nucleic acid molecule may be detected, including direct and indirect methods of detecting the presence or absence of the specific nucleic acid. Different alleles may, but need not, result in detectable differences in gene expression or protein functions. An allele of a gene may or may not encode proteins or peptides. Different alleles may differ in expression level, pattern, temporal or spatial specificity, and expression regulation. In the case of encoded proteins, the protein from different alleles may or may not be functional. Further, the protein may be gain-of-function, loss-of-function, or with altered function. An allele may also be called a mutation or a mutant. An allele may be compared to another allele that may be termed a wild type form of an allele. In some cases, the wild type allele is more common than the mutant.

Different combinations of polymorphisms may also be called haplotypes. The polymorphism may be a single nucleotide polymorphism. The genetic sequences of different individuals are remarkably similar. When the chromosomes of two humans are compared, their DNA sequences can be identical for hundreds of bases. But at about one in every 1000 to 1,200 bases, on average, the sequences will differ. As such, one individual might have an A at that location, while another individual has a G, or a person might have extra bases at a given location or a missing segment of DNA. Differences in individual bases are the most common type of genetic variation. These genetic differences are known as single nucleotide polymorphisms (SNPs) (supra). SNPs act as markers to locate genes in DNA. Given the relatively close spacing between these SNPs, SNPs are typically inherited in blocks.

The difference of a single genetic variance such as a SNP can delineate a distinct haplotype. A "SNP haplotype block" or "haplotype block" is a nucleic acid sequence containing a group of SNPs or polymorphisms that do not appear to recombine independently resulting in reduced genetic variability but are passed together from generation to generation in variable-length blocks. The combination of polymorphisms, haplotype patterns and haplotype blocks may be referred to as a "haplotype" or "haplotype structure" in a nucleic acid sequence of interest. For example, a haplotype can be a set of SNPs, alleles, or genetic markers on a single chromatid that are genetically linked and thus are likely to be inherited as a unit. "Linked", "linkage", or "allelic association" means the preferential association of a particular allele or genetic marker with a specific allele or genetic marker at a nearby chromosomal location more frequently than expected by chance for any particular allele frequency in the population. For example, if locus X has alleles a and b, which occur equally frequently, and linked locus Y has alleles c and d, which occur equally frequently, one would expect the combination ac to occur with a frequency of 0.25. If ac occurs more frequently, then alleles a and c are in linkage disequilibrium. Linkage disequilibrium may result from natural selection of certain combination of alleles or because an allele has been introduced into a population too recently to have reached equilibrium with linked alleles. A marker in linkage disequilibrium can be particularly useful in detecting susceptibility to disease (or other phenotype) notwithstanding that the marker does not cause the disease. For example, a marker (X) that is not itself a causative element of a disease, but which is in linkage disequilibrium with a gene (including regulatory sequences) (Y) that is a causative element of a phenotype, can be detected to indicate susceptibility to the disease in circumstances in which the gene Y may not have been identified or may not be readily detectable.

Haplotypes are the particular combinations of alleles observed in a population, and are regions over which there is a very small proportion (often less than 5%) of informative SNP pairs showing strong evidence of historical recombination. Haplotype patterns may be disrupted by forces other than recombination, such as, recurrent mutation, gene conversion, or simply genome assembly or genotyping errors, which accounts for the approximate 5% disruption. Generally, directly genotyping pedigrees and using molecular methods, such as allele-specific polymerase chain reaction (AS-PCR) and somatic cell hybrids, in combination with genotyping can unambiguously assign alleles to chromosomes and thus determine the haplotypes. Other methods of determining or constructing a haplotype include statistical inference using various algorithms to process genotype data. Further, two or more alleles likely to be inherited as a unit is termed a haplotype block. Typically, a haplotype block refers to a chromosome region of high linkage disequilibrium and low haplotype diversity, and are regions of low recombination flanked by recombination hotspots (e.g., Cardon, L R and Abecasis, G R, *Trends in Genetics,* 19(3):135-140 (2003)).

As described above, two or more alleles likely to be inherited as a unit may be termed a haplotype block. When one or more haplotype blocks are associated with a phenotypic trait, the haplotype block serves as a genetic marker represented by a genetic locus comprising one or more linked genetic variations that would be inherited as a unit more frequently than not in an individual having the associated phenotypic trait. Therefore the haplotype block, and/or the haplotype may also be used to identify individuals from biological samples for traits of interest. The haplotype block may, in turn, be used to identify individual polymorphic sites, or candidate disease-associated genes for developing therapeutics and diagnostics. In the present invention, a DLA class II region comprising SEQ ID NO. 1 is identified as having significant association to the risk of NME. The haplotype comprising SEQ ID NO. 1 may be further described using 35 tag SNPs, or 19 haplotype blocks, some of which can be detected by one or more tag SNPs as disclosed. As disclosed in the present invention, the haplotype, the tag SNPs and the haplotype blocks are markers or marker combinations that can be used for NME identification and treatment. The present invention also discloses a STYX region containing a haplotype associated to the risk of NME genes for developing therapeutics and diagnostics.

Other additional markers that may also be used are those genetically linked to the markers disclosed herein. These additional markers, such as, SNPs or other polymorphic markers, are in close enough proximity to have a statistically significant association with the marker disclosed herein. Such statistically significant association may be defined by linkage disequilibrium, and the subject may be placed into a group either at higher or lower risk for NME depending on the presence of the additional marker, or a close isoform thereof, that is closely linked to higher or lower risk indicating markers.

Examples of methods for detecting the haplotype blocks are described herein and other suitable methods are well known to those of skill in the art. Suitable methods for detecting haplotypes in a sample include sequence analysis, hybridization analysis using a nucleic acid probe such DNA or RNA (e.g., Northern analysis, Southern analysis, dot blot analysis), and restriction digestion, genotyping the tag SNP(s) of the haplotype in each haplotype block.

In the methods of the invention, a sample can be obtained from the individual and used in the methods to detect the presence of the haplotype blocks. The haplotype block can be detected in any sample obtained from the individual that comprises the individual's DNA. For example, a haplotype block can be detected in a tissue sample (e.g., skin, muscle, organ, placenta), a cell sample (e.g., fetal cells), a fluid sample (e.g., blood, amniotic fluid, cerebrospinal fluid, urine, lymph) and any combination thereof. Methods of obtaining such samples or extracting nucleic acid from such samples are known to those of skill in the art.

The detection of the haplotype block in the individual can be compared to a control. Suitable controls for use in the methods provided herein are apparent to those of skill in the art. For example, a suitable control can be established by assaying one or more subjects which do not have NME. Alternatively, a control can be obtained using a statistical model to obtain a control value (standard value; known standard). See, for example, models described in Knapp, R. G. and Miller M. C. (1992) Clinical Epidemiology and Biostatistics, William and Wilkins, Harual Publishing Co. Malvern, Pa., which is incorporated herein by reference.

Various parameters may be used to assess how accurately the presence or absence of a marker signifies a particular physiological or cellular characteristic. Such parameters include a positive likelihood ratio, negative likelihood ratio, odds ratio, and/or hazard ratio. When a SNP haplotype block is identified by a SEQ ID NO, a set of at least two SNPs that are associated with an allele of a gene are grouped together in a linkage unit or block. In one embodiment of the present invention, the presence of SNPs detected in a given haplotype block disclosed herein in a dog is associated with a greater risk that the dog will develop NME, if it has not yet shown symptoms of NME; whereas the absence of SNPs detected in a given haplotype block disclosed herein in a dog is associated with a lesser risk that the dog will develop NME. A nucleic acid may be termed to be specific to a SNP haplotype block or specific to a SNP within a haplotype block. A nucleic acid specific to a haplotype block or a SNP within a haplotype block contains sequence that is complementary to one of the double stranded nucleic acid sequence of at least one SNP that is grouped within that haplotype block. Such nucleic acids may be complementary to a SNP that is associated with the nucleotide sequence in the linkage unit or block or any other SNP associated within the haplotype identified by the SNP haplotype block.

In various embodiments, the present technology provides a combination of markers comprising one or more haplotype blocks for identifying NME in canines. The haplotype blocks may be in a DLA class II region of canine chromosome 12, wherein the DLA class II region comprises sequence having at least 80%, more preferably 90%, still more preferably 95%, 96%, 97%, 98%, 99%, 99.5% or 99.9% sequence identity with SEQ ID NO. 1, wherein SEQ ID NO.1 has a start-end position from 4713000 to 8834700. The one or more haplotype blocks is selected from the group consisting of any one of haplotype blocks 1-19 and any combination thereof in Table 3. Further, the DLA class II region of chromosome 12 comprising the nucleic acid sequence of SEQ ID No. 1 may be defined by one or more tagging SNPs. The one or more tagging SNPs is selected from the group consisting of nucleic acid variation at position 5166878=A or G, 5217389=G or A, 5227499=G or A, 5275229=A or T, 5622709=C or A, 5710832=A or G, 5734305=A or G, 5791672=G or A, 5829667=A or G, 5843592=G or C, 5916360=A or G, 5931001=G or A, 5935549=A or G, 5992526=A or G, 6024841=T or A, 6028685=G or A, 6059850=A or G, 6064245=C or A, 6149213=G or A, 6160615=A or C, 6164202=A or G, 6184107=G or A, 6197313=A or C, 6200280=G or A, 6218850=A or G, 6238545=A or G, 6257019=G or A, 6289014=G or A, 6299459=A or G, 6311277=C or A, 6320910=A or G, 6342204=A or C, 6653816=A or G, 6686088=G or A, 6793393=A or G, 6809061=A or G, 6832252=A or G, and 8822596=C or G, for which 5166878=A, 5217389=G, 5227499=G, 5275229=A, 5622709=C, 5710832=A, 5734305=A, 5791672=G, 5829667=A, 5843592=G, 5916360=A, 5931001=G, 5935549=A, 5992526=A, 6024841=T, 6028685=G, 6059850=A, 6064245=C, 6149213=G, 6160615=A, 6164202=A, 6184107=G, 6197313=A, 6200280=G, 6218850=A, 6238545=A, 6257019=G, 6289014=G, 6299459=A, 6311277=C, 6320910=A, 6342204=A, 6653816=A, 6686088=G, 6793393=A, 6809061=A, 6832252=A and 8822596=C are risk alleles associated with developing Necrotizing Meningoencephalitis; wherein the two or more risk alleles are in linkage disequilibrium with one another.

In one example, the combination of markers comprising one or more haplotype blocks in a DLA class II region of canine chromosome 12 contains one or more haplotype blocks that is selected from the group consisting of haplotype blocks 4-8 and 19, and any combination thereof in Table 3. For example, the haplotype block 4 can be identified by one or more tagging SNP selected from the group consisting of nucleic acid variations at position 5166878=A or G, 5217389=G or A, 5227499=G or A, and 5275229=A or T; wherein 5166878=A, 5217389=G, 5227499=G, and 5275229=A are risk alleles associated with developing Necrotizing Meningoencephalitis. The haplotype block 5 can be identified by a tagging SNP having nucleic acid variations at position 5622709=C or A; wherein 5622709=C is a risk allele. The haplotype block 6 can be identified by one or more tagging SNP selected from the group consisting of nucleic acid variations at position 5710832=A or G, 5734305=A or G, 791672=G or A, 5829667=A or G, 5843592=G or C, 5916360=A or G, 5931001=G or A, 5935549=A or G, 5992526=A or G, 6024841=T or A, 6028685=G or A, 6059850=A or G, and 6064245=C or A; wherein 5710832=A, 5734305=A, 5791672=G, 5829667=A, 5843592=G, 5916360=A, 5931001=G, 5935549=A, 5992526=A, 6024841=T, 6028685=G, 6059850=A, and 6064245=C are risk alleles. The haplotype block 7 is identified by one or more tagging SNP selected from the group consisting of nucleic acid variations at position 6149213=G or A, 6160615=A or C, 6164202=A or G, 6184107=G or A, 6197313=A or C, 6200280=G or A, 6218850=A or G, 6238545=A or G, 6257019=G or A, 6289014=G or A, 6299459=A or G, 6311277=C or A, 6320910=A or G, 6342204=A or C; wherein 6149213=G, 6160615=A, 6164202=A, 6184107=G, 6197313=A, 6200280=G, 6218850=A, 6238545=A, 6257019=G, 6289014=G, 6299459=A, 6311277=C, 6320910=A, and 6342204=A are risk alleles associated with developing Necrotizing Meningoencephalitis. The haplotype block 8 is identified by one or more tagging SNP selected from the group consisting of nucleic acid variations at position 6653816=A or G, 6686088=G or A, 6793393=A or G, 6809061=A or G, 6832252=A or G, wherein 6653816=A or G, 6686088=G or A, 6793393=A or G, 6809061=A or G, 6832252=A or G are risk alleles. The haplotype block 19 is identified by a tagging SNP having nucleic acid variations at position 8822596=C or G; wherein 8822596=C is a risk allele associated with developing Necrotizing Meningoencephalitis.

The combination of markers for identifying NME in canine, which comprises one or more haplotype blocks in a DLA class II region of canine chromosome 12, having a start-end position from about 4713000 to about 8834700, may further comprise a haplotype block in STYX region of chromosome 8, wherein the STYX region comprises sequence having at least 80%, more preferably 90%, still more preferably 95%, 96%, 97%, 98%, 99%, 99.5% or 99.9% sequence identity with SEQ ID No. 2, wherein SEQ ID No. 2 has a start-end position from 31736000 to 32225100. This STYX region of chromosome 8 comprises a tagging SNP having nucleic acid variation at position 31971609=A or G, wherein 31971609=A is a risk allele associated with developing Necrotizing Meningoencephalitis.

The combination of markers for identifying NME in canine, which comprises one or more haplotype blocks in a DLA class II region of canine chromosome 12, having a start-end position from about 4713000 to about 8834700, may further comprise a HLA-DPB1 single base deletion variant at position 5608903, wherein the deletion variant comprising SEQ ID NO.26 is associated with developing Necrotizing Meningoencephalitis. The haplotype block 7 can be identified by the HLA-DPB1 single base deletion variant comprising SEQ ID NO.26. The haplotype block 7 may be further identified by the HLA-DPB1 single base deletion variant comprising SEQ ID NO.26 and a tagging SNP comprising nucleic acid variations at position 5622709=C or A; wherein 5622709=C is a risk allele associated with developing Necrotizing Meningoencephalitis. The one or more haplotype blocks of the combination of markers in a DLA class II region of canine chromosome 12 may be detected by genotyping using PCR, sequencing, hybridization, restriction digestion, or any combination thereof. The combinations of the markers as disclosed herein are suitable for canine species selected from a group consisting of Pug, Chihuahua, West Highland White Terrier, Pekingese, Labrador Retriever, Golden Retriever, Beagle, German Shepherd, Dachshund, Yorkshire Terrier, Boxer, Poodle, Shih Tzu, Miniature Schnauzer, Pomeranian, Cocker Spaniel, Rottweiler, Bulldog, Shetland Sheepdog, Boston Terrier, Miniature Pinscher, Maltese, German Shorthaired Pointer, Doberman Pinscher, Siberian Husky, Pembroke Welsh Corgi, Basset Hound, Bichon Frise, and other currently recognized and or yet to be recognized breeds.

The present invention further provides a combination of markers for identifying NME in canine which comprises a HLA-DPB1 single base deletion variant at position 5608903 of canine chromosome 12, and the deletion variant comprising SEQ ID NO.26 is associated with developing Necrotizing Meningoencephalitis. In addition to a HLA-DPB1 single base deletion variant at position 5608903 of canine chromosome 12, such a combination of markers further comprises one or more tagging SNPs selected from the group consisting of nucleic acid variations at position 5166878=A or G, 5217389=G or A, 5227499=G or A, 5275229=A or T, 5622709=C or A, 5710832=A or G, 5734305=A or G, 5791672=G or A, 5829667=A or G, 5843592=G or C, 5916360=A or G, 5931001=G or A, 5935549=A or G, 5992526=A or G, 6024841=T or A, 6028685=G or A, 6059850=A or G, 6064245=C or A, 6149213=G or A, 6160615=A or C, 6164202=A or G, 6184107=G or A, 6197313=A or C, 6200280=G or A, 6218850=A or G, 6238545=A or G, 6257019=G or A, 6289014=G or A, 6299459=A or G, 6311277=C or A, 6320910=A or G, 6342204=A or C, 6653816=A or G, 6686088=G or A, 6793393=A or G, 6809061=A or G, 6832252=A or G, and 8822596=C or G; for which, 5166878=A, 5217389=G, 5227499=G, 5275229=A, 5622709=C, 5710832=A, 5734305=A, 5791672=G, 5829667=A, 5843592=G, 5916360=A, 5931001=G, 5935549=A, 5992526=A, 6024841=T, 6028685=G, 6059850=A, 6064245=C, 6149213=G, 6160615=A, 6164202=A, 6184107=G, 6197313=A, 6200280=G, 6218850=A, 6238545=A, 6257019=G, 6289014=G, 6299459=A, 6311277=C, 6320910=A, 6342204=A, 6653816=A, 6686088=G, 6793393=A, 6809061=A, 6832252=A; and 8822596=C are risk alleles associated with developing Necrotizing Meningoencephalitis; wherein the two or more risk alleles are in linkage disequilibrium with one another.

The present invention also provides a method of classifying a subject to an NME disease risk group, which comprises the steps of receiving a nucleic acid-containing sample from the subject; detecting the presence of a combination of markers comprising one or more haplotype blocks and tagging SNPs in a DLA class II region of canine chromosome 12 comprising sequences having at least 80%, more preferably 90%, still more preferably 95%, 96%, 97%, 98%, 99%, 99.5% or 99.9% sequence identity with SEQ ID No. 1, wherein SEQ ID No.1 has start-end position from 4713000 to 8834700; and classifying the subject into a risk group based upon the presence of at least one haplotype block, or classifying the subject into a non-risk group based upon the absence of any haplotype block. In the general method, the one or more haplotype blocks is selected from the group consisting of haplotype blocks 1-19 and any combination thereof in Table 3. Further, the one or more tagging SNPs in the general method is selected from the group consisting of nucleic acid variation at position 5166878=A or G, 5217389=G or A, 5227499=G or A, 5275229=A or T, 5622709=C or A, 5710832=A or G, 5734305=A or G, 5791672=G or A, 5829667=A or G, 5843592=G or C, 5916360=A or G, 5931001=G or A, 5935549=A or G, 5992526=A or G, 6024841=T or A, 6028685=G or A, 6059850=A or G, 6064245=C or A, 6149213=G or A, 6160615=A or C, 6164202=A or G, 6184107=G or A, 6197313=A or C, 6200280=G or A, 6218850=A or G, 6238545=A or G, 6257019=G or A, 6289014=G or A, 6299459=A or G, 6311277=C or A, 6320910=A or G, 6342204=A or C, 6653816=A or G, 6686088=G or A, 6793393=A or G, 6809061=A or G, 6832252=A or G, and 8822596=C or G, for which 5166878=A, 5217389=G, 5227499=G, 5275229=A, 5622709=C, 5710832=A, 5734305=A, 5791672=G, 5829667=A, 5843592=G, 5916360=A, 5931001=G, 5935549=A, 5992526=A, 6024841=T, 6028685=G, 6059850=A, 6064245=C, 6149213=G, 6160615=A, 6164202=A, 6184107=G, 6197313=A, 6200280=G, 6218850=A, 6238545=A, 6257019=G, 6289014=G, 6299459=A, 6311277=C, 6320910=A, 6342204=A, 6653816=A, 6686088=G, 6793393=A, 6809061=A, 6832252=A; and 8822596=C are risk alleles associated with developing Necrotizing Meningoencephalitis; wherein the two or more risk alleles are in linkage disequilibrium with one another. The general method provided herein is suitable for canine species selected from a group consisting of Pug, Chihuahua, West Highland White Terrier, Pekingese, Labrador Retriever, Golden Retriever, Beagle, German Shepherd, Dachshund, Yorkshire Terrier, Boxer, Poodle, Shih Tzu, Miniature Schnauzer, Pomeranian, Cocker Spaniel, Rottweiler, Bulldog, Shetland Sheepdog, Boston Terrier, Miniature Pinscher, Maltese, German Shorthaired Pointer, Doberman Pinscher, Siberian Husky, Pembroke Welsh Corgi, Basset Hound, Bichon Frise, and other currently recognized and or yet to be recognized breeds.

One aspect of the present invention provides an isolated nucleic acid molecule selected from the group consisting of: (a) an isolated nucleic acid molecule comprising the sequence of SEQ ID NO:1; (b) an isolated nucleic acid molecule comprising the sequence of SEQ ID NO:2; (c) an isolated nucleic acid molecule comprising a segment of SEQ ID NO:1; (d) an isolated nucleic acid molecule comprising a segment of SEQ ID NO:2; and, (e) an isolated nucleic molecule which is complementary to the isolated nucleic acid molecule of (a), (b), (c), and (d); wherein the isolated nucleic acid molecule comprises one or more markers selected from the group consisting of SNP alleles, haplotype blocks, or gene indel variants that are associated with a risk or non-risk of developing Necrotizing Meningoencephalitis in a subject. The marker is selected from the group consisting of SNPs as listed in FIG. 1 and FIG. 2, haplotype blocks listed in Table 3 and Table 4, and gene indel variants in the DLA II region of canine Chromosome 12 and the STYX region of Chromosome 8.

In some examples, said isolated nucleic acid molecule comprises two or more single nucleotide polymorphisms (SNPs) as listed in FIG. 1 and FIG. 2, wherein the two or more SNPs are in linkage disequilibrium with one another. In one example, the gene indel variant is an HLA-DPB1 deletion variant represented by SEQ ID NO: 26, and this deletion allele of HLA-DPB1 is associated with a risk of developing Necrotizing Meningoencephalitis. In another example, the one or more SNPs having loci in the sequence of SEQ ID NO: 1 and SEQ ID NO: 2 are selected from a group consisting of nucleotide variations: 5166878=A or G; 5217389=G or A; 5227499=G or A; 5275229=A or T; 5622709=C or A; 5710832=A or G; 5734305=A or G; 5791672=G or A; 5829667=A or G; 5843592=G or C; 5916360=A or G; 5931001=G or A; 5935549=A or G; 5992526=A or G; 6024841=T or A; 6028685=G or A; 6059850=A or G; 6064245=C or A; 6149213=G or A; 6160615=A or C; 6164202=A or G; 6184107=G or A; 6197313=A or G; 6200280=G or A; 6218850=A or G; 6238545=A or G; 6257019=G or A; 6289014=G or A; 6299459=A or G; 6311277=C or A; 6320910=A or G; 6342204=A or C; 6653816=A or G; 6686088=G or A; 6793393=A or G; 6809061=A or G; 6832252=A or G; 8822596=C or G, on canine Chromosome 12 at the indicated position; and 31971609=A or G on canine Chromosome 8 at the indicated position. Specifically, the one or more SNPs that are associated with a risk of developing Necrotizing Meningoencephalitis are selected from a group consisting of nucleotide: 5166878=A; 5217389=G; 5227499=G; 5275229=A; 5622709=C; 5710832=A; 5734305=A; 5791672=G; 5829667=A; 5843592=G; 5916360=A; 5931001=G; 5935549=A; 5992526=A; 6024841=T; 6028685=G; 6059850=A; 6064245=C; 6149213=G; 6160615=A; 6164202=A; 6184107=G; 6197313=A; 6200280=G; 6218850=A; 6238545=A; 6257019=G; 6289014=G; 6299459=A; 6311277=C; 6320910=A; 6342204=A; 6653816=A; 6686088=G; 6793393=A; 6809061=A; 6832252=A; 8822596=C, on canine Chromosome 12 at the indicated position; and 31971609=A on canine Chromosome 8 at the indicated position. In still another example, the one or more haplotype blocks that are associated with a risk of developing Necrotizing Meningoencephalitis are selected from a group consisting of sequences represented by: SEQ ID NO: 3 at position 4713392-4821633, SEQ ID NO:4 at position 4836721-4923170, SEQ ID NO:5 at position 4938082-5088561, SEQ ID NO:6 at position 5108726-5364188, SEQ ID NO:7 at position 5491709-5672682, SEQ ID NO:8 at position 5710832-6078099, SEQ ID NO:9 at position 6149213-6342204, SEQ ID NO:10 at position 6492201-6982375, SEQ ID NO:11 at position 6992493-7270218, SEQ ID NO:12 at position 7338759-7350261, SEQ ID NO:13 at position 7384390-7643147, SEQ ID NO:14 at position 7725530-7830733, SEQ ID NO:15 at position 7927872-7944953, SEQ ID NO:16 at position 7950821-8158994, SEQ ID NO:17 at position 8208369-8265940, SEQ ID NO:18 at position 8327142-8386063, SEQ ID NO:19 at position 8429601-8533350, SEQ ID NO:20 at position 8546686-8713747, SEQ ID NO:21 at position 8719506-8834652, on canine Chromosome 12; and SEQ ID NO: 22 at position 31,736,206 to 31,795,128, SEQ ID NO: 23 at position 31,866,373 to 31,883,390, SEQ ID NO: 24 at position 31,971,609 to 32,009,283, and SEQ ID NO: 25 at position 32,183,184 to 32,225,068, on canine Chromosome 8. In some examples, the isolated nucleic acid molecule may be in the form of a probe or primer, and the probe or primer hybridizes under stringent conditions to said isolated nucleic acid molecule of claim 1.

Another aspect of the present invention provides a method of classifying a subject to an NME disease risk group. The method comprises (1) receiving a nucleic acid-containing sample from the subject; (2) detecting the presence of one or more markers selected from the group consisting of one or more SNP alleles, haplotype blocks, and gene indel variants that are associated with a risk of developing Necrotizing Meningoencephalitis in the subject, wherein the SNP alleles, haplotype blocks, and gene indel variants are represented by nucleic acid segments in SEQ ID NO:1 and SEQ ID NO:2; and (3) classifying the subject into a risk group based upon the presence of at least one haplotype block, or classifying the subject into a non-risk group based upon the absence of any haplotype block. In one example of performing the general method, the one or more SNP alleles are selected from the group consisting of nucleotide: 5166878=A; 5217389=G; 5227499=G; 5275229=A; 5622709=C; 5710832=A; 5734305=A; 5791672=G; 5829667=A; 5843592=G; 5916360=A; 5931001=G; 5935549=A; 5992526=A; 6024841=T; 6028685=G; 6059850=A; 6064245=C; 6149213=G; 6160615=A; 6164202=A; 6184107=G; 6197313=A; 6200280=G; 6218850=A; 6238545=A; 6257019=G; 6289014=G; 6299459=A; 6311277=C; 6320910=A; 6342204=A; 6653816=A; 6686088=G; 6793393=A; 6809061=A; 6832252=A; 8822596=C, on canine Chromosome 12 at the indicated position; and 31971609=A on canine Chromosome 8 at the indicated position.

In another example of performing the general method, the one or more haplotype blocks are selected from the group consisting of sequences represented by: SEQ ID NO: 3 at position 4713392-4821633, SEQ ID NO:4 at position 4836721-4923170, SEQ ID NO:5 at position 4938082-5088561, SEQ ID NO:6 at position 5108726-5364188, SEQ ID NO:7 at position 5491709-5672682, SEQ ID NO:8 at position 5710832-6078099, SEQ ID NO:9 at position 6149213-6342204, SEQ ID NO:10 at position 6492201-6982375, SEQ ID NO:11 at position 6992493-7270218, SEQ ID NO:12 at position 7338759-7350261, SEQ ID NO:13 at position 7384390-7643147, SEQ ID NO:14 at position 7725530-7830733, SEQ ID NO:15 at position 7927872-7944953, SEQ ID NO:16 at position 7950821-8158994, SEQ ID NO:17 at position 8208369-8265940, SEQ ID NO:18 at position 8327142-8386063, SEQ ID NO:19 at position 8429601-8533350, SEQ ID NO:20 at position 8546686-8713747, SEQ ID NO:21 at position 8719506-8834652, on canine Chromosome 12; and SEQ ID NO: 22 at position 31,736,206 to 31,795,128, SEQ ID NO: 23 at position 31,866,373 to 31,883,390, SEQ ID NO: 24 at position 31,971,609 to 32,009,283, and SEQ ID NO: 25 at position 32,183,184 to 32,225,068, on canine Chromosome 8.

In yet another example of performing the general method, the marker is the gene indel variant HLA-DPB1 deletion variant represented by SEQ ID NO: 26.

Another aspect of the present invention provides a set of molecular probes used in assessing the risk of developing NME of a subject, which comprises a first probe capable of detecting a first marker selected from the group consisting of a SNP allele listed in FIG. 1 and FIG. 2, a haplotype block in Table 3 and Table 4, and an HLA-DPB1 deletion variant represented by SEQ ID NO: 26; and a second probe, different from the first probe, capable of detecting a second marker selected from the group consisting of a SNP allele listed in FIG. 1 and FIG. 2, a haplotype block in Table 3 and Table 4, and an HLA-DPB1 deletion variant represented by SEQ ID NO: 26, wherein the markers detected by the probes are associated with a high risk of developing NME and wherein the risk group comprises subjects with a high risk of developing NME.

A marker may be any molecular structure produced by a cell, expressed inside the cell, accessible on the cell surface, or secreted by the cell. A marker may be any protein, carbohydrate, fat, nucleic acid, catalytic site, or any combination of these such as an enzyme, glycoprotein, cell membrane, virus, cell, organ, organelle, or any uni- or multimolecular structure or any other such structure now known or yet to be disclosed whether alone or in combination. A marker may also be called a target and the terms are used interchangeably.

A marker may be represented by the sequence of a nucleic acid from which it can be derived or any other chemical structure. Examples of such nucleic acids include miRNA, tRNA, siRNA, mRNA, cDNA, or genomic DNA sequences including complimentary sequences. Alternatively, a marker may be represented by a protein sequence. The concept of a marker is not limited to the products of the exact nucleic acid sequence or protein sequence by which it may be represented. Rather, a marker encompasses all molecules that may be detected by a method of assessing the expression of the marker. In some embodiments, the detection of the marker may encompass the detection and/or determination of a change in copy number (e.g. copy number of a gene or other forms of nucleic acid) or in the detection of one or more translocations.

Examples of molecules encompassed by a marker represented by a particular sequence or structure include point mutations, silent mutations, deletions, frameshift mutations, translocations, alternative splicing derivatives, differentially methylated sequences, differentially modified protein sequences, truncations, soluble forms of cell membrane associated markers, and any other variation that results in a product that may be identified as the marker. The following nonlimiting examples are included for the purposes of clarifying this concept: If expression of a specific marker in a sample is assessed by RTPCR, and if the sample expresses an mRNA sequence different from the sequence used to identify the specific marker by one or more nucleotides, but the marker may still be detected using RTPCR, then the specific marker encompasses the sequence present in the sample. Alternatively, if expression of a specific marker in a sample is assessed by an antibody and the amino acid sequence of the marker in the sample differs from a sequence used to identify marker by one or more amino acids, but the antibody is still able to bind to the version of the marker in the sample, then the specific marker encompasses the sequence present in the sample.

In the present technology, the marker represented by a group of linked SNPs, "haplotype block," "haplotype", or gene products, including mRNA and protein, produced from the genes within the haplotype may be detected by a variety of methodologies or procedures that are well known in the art including, but not limited to, nucleic acid hybridization, antibody binding, activity assay, polymerase chain reaction (PCR), SI nuclease assay and via gene chip or microarray, as well as any other assay known in the art that may be used to detect the SNPs associated with a haplotype or the gene product produced from the gene of the haplotype including mRNA and protein. Hybridization of a SNP-specific oligonucleotide to a target polynucleotide may be performed with both entities in solution, or such hybridization may be performed when either the oligonucleotide or the target polynucleotide is covalently or noncovalently affixed to a solid support. Attachment may be mediated, for example, by antibody-antigen interactions, poly-L-Lys, streptavidin or avidin-biotin interactions, salt bridges, hydrophobic interactions, chemical linkages, UV cross-linking baking, etc. SNP-specific oligonucleotides may be synthesized directly on the solid support or attached to the solid support subsequent to synthesis. Solid-supports suitable for use in detection methods of the disclosure include substrates made of silicon, glass, plastic, paper and the like, which may be formed, for example, into wells (as in 96-well plates), slides, sheets, membranes, fibers, chips, dishes, and beads. The solid support may be treated, coated or derivatized to facilitate the immobilization of the SNP-specific oligonucleotide or target nucleic acid. Detecting the nucleotide or nucleotide pair of interest may also be determined using a mismatch detection technique, including but not limited to the RNase protection method using riboprobes (Winter et al. (1985) *Proc. Natl. Acad. Sci. USA* 82:7575; Meyers et al. (1985) *Science* 230:1242) and proteins which recognize nucleotide mismatches, such as the *E. coli* mutS protein (Modrich (1991) *Ann. Rev. Genet.* 25:229-53). Alternatively, variant SNPs or variant alleles can be identified by single strand conformation polymorphism (SSCP) analysis (Orita et at. (1989) *Genomics* 5:874-9); Humphries et al. (1996) in MOLECULAR DIAGNOSIS OF GENETIC DISEASES, Elles, ed., pp. 321-340) or denaturing gradient gel electrophoresis (DGGE) (Wartell et al. (1990) *Nucl. Acids Res.* 18:2699706); Sheffield et al. (1989) *Proc. Natl. Acad. Sci. USA* 86:232-6).

A polymerase-mediated primer extension method may also be used to identify the polymorphism(s). Several such methods have been described in the patent and scientific literature and include the "Genetic Bit Analysis" method (WO 92/15712) and the ligase/polymerase mediated genetic bit analysis (U.S. Pat. No. 5,679,524. Related methods are disclosed in WO 91/102087, WO 90/09455, WO 95/17676, and U.S. Pat. Nos. 5,302,509 and 5,945,283. Extended primers containing the complement of the polymorphism may be detected by mass spectrometry as described in U.S. Pat. No. 5,605,798. Another primer extension method is allele-specific PCR (Ruano et al. (1989) *Nucl. Acids Res.*

17:8392; Ruano et al. (1991) *Nucl. Acids Res.* 19:6877-82); WO 93/22456; Turki et al. (1995) 1. *Clin. Invest.* 95:1635-41). The haplotype for a gene of an individual may also be determined by hybridization of a nucleic acid sample containing one or both copies of the gene, mRNA, cDNA or fragment(s) thereof, to nucleic acid arrays and sub-arrays such as described in WO 95/112995. The arrays would contain a battery of SNP-specific or allele-specific oligonucleotides representing each of the polymorphic sites to be included in the haplotype.

Detecting the presence or absence of a marker disclosed herein or a close isoform thereof may be carried out either directly or indirectly by any suitable methodology. A variety of techniques are known to those skilled in the art (supra). All generally involve receiving a biological sample containing DNA or protein from the subject, and then detecting whether or not the marker or a close isoform thereof is present in the sample, and then determining the presence or absence of the marker in the sample.

The marker may be detected by any of a number of methods. Direct methods of detecting the presence of an allele include but are not limited to any form of DNA sequencing including Sanger, next generation sequencing, pyrosequencing, SOLID sequencing, massively parallel sequencing, pooled, and barcoded DNA sequencing or any other sequencing method now known or yet to be disclosed; PCR-based methods such as real-time PCR, quantitative PCR, reverse transcription PCR or any combination of these; allele specific ligation; comparative genomic hybridization; or any other method that allows the detection of a particular nucleic acid sequence within a sample or enables the differentiation of one nucleic acid from another nucleic acid that differs from the first nucleic acid by one or more nucleotides.

Some embodiments of the invention may comprise the use of one or more methods of amplifying a nucleic acid-based starting material (i.e., a template). Nucleic acids may be selectively and specifically amplified from a template nucleic acid contained in a sample. In some nucleic acid amplification methods, the copies are generated exponentially. Examples of nucleic acid amplification methods known in the art include: polymerase chain reaction (PCR), ligase chain reaction (LCR), self-sustained sequence replication (3SR), nucleic acid sequence based amplification (NASBA), strand displacement amplification (SDA), amplification with Qβ replicase, whole genome amplification with enzymes such as φ29, whole genome PCR, in vitro transcription with T7 RNA polymerase or any other RNA polymerase, or any other method by which copies of a desired sequence are generated.

In addition to genomic DNA, any oligonucleotide or polynucleotide sequence can be amplified with an appropriate set of primer molecules. In particular, the amplified segments created by the PCR process itself are, themselves, efficient templates for subsequent PCR amplifications.

PCR generally involves the mixing of a nucleic acid sample, two or more primers that are designed to recognize the template DNA, a DNA polymerase, which may be a thermostable DNA polymerase such as Taq or Pfu, and deoxyribose nucleoside triphosphates (dNTP's). Reverse transcription PCR, quantitative reverse transcription PCR, and quantitative real time reverse transcription PCR are other specific examples of PCR. In general, the reaction mixture is subjected to temperature cycles comprising a denaturation stage (typically 80-100° C.), an annealing stage with a temperature that is selected based on the melting temperature (Tm) of the primers and the degeneracy of the primers, and an extension stage (for example 40-75° C.). In real-time PCR analysis, additional reagents, methods, optical detection systems, and devices known in the art are used that allow a measurement of the magnitude of fluorescence in proportion to concentration of amplified DNA. In such analyses, incorporation of fluorescent dye into the amplified strands may be detected or measured.

Alternatively, labeled probes that bind to a specific sequence during the annealing phase of the PCR may be used with primers. Labeled probes release their fluorescent tags during the extension phase so that the fluorescence level may be detected or measured. Generally, probes are complementary to a sequence within the target sequence downstream from either the upstream or downstream primer. Probes may include one or more label. A label may be any substance capable of aiding a machine, detector, sensor, device, or enhanced or unenhanced human eye from differentiating a labeled composition from an unlabeled composition. Examples of labels include but are not limited to: a radioactive isotope or chelate thereof, dye (fluorescent or nonfluorescent,) stain, enzyme, or nonradioactive metal. Specific examples include, but are not limited to: fluorescein, biotin, digoxigenin, alkaline phosphatese, biotin, streptavidin, 3H, 14C, 32P, 35S, or any other compound capable of emitting radiation, rhodamine, 4-(4'-dimethyl-amino-phenylazo) benzoic acid ("Dabcyl"); 4-(4'-dimethyl-amino-phenylazo)sulfonic acid (sulfonyl chloride) ("Dabsyl"); 5-((2-aminoethyl)-amino)-naphtalene-1-sulfonic acid ("EDANS"); Psoralene derivatives, haptens, cyanines, acridines, fluorescent rhodol derivatives, cholesterol derivatives; ethylenediaminetetraaceticacid ("EDTA") and derivatives thereof or any other compound that may be differentially detected. The label may also include one or more fluorescent dyes optimized for use in genotyping. Examples of dyes facilitating the reading of the target amplification include, but are not limited to: CAL-Fluor Red 610, CAL-Fluor Orange 560, dR110, 5-FAM, 6FAM, dR6G, JOE, HEX, VIC, TET, dTAMRA, TAMRA, NED, dROX, PET, BHQ+, Gold540, and LIZ.PCR facilitating the reading of the target amplification.

Either primers or primers along with probes allow a quantification of the amount of specific template DNA present in the initial sample. In addition, RNA may be detected by PCR analysis by first creating a DNA template from RNA through a reverse transcriptase enzyme. The marker expression may be detected by quantitative PCR analysis facilitating genotyping analysis of the samples.

An illustrative example, using dual-labeled oligonucleotide probes in PCR reactions is disclosed in U.S. Pat. No. 5,716,784 to DiCesare. In one example of the PCR step of the multiplex Real Time-PCR/PCR reaction of the present invention, the dual-labeled fluorescent oligonucleotide probe binds to the target nucleic acid between the flanking oligonucleotide primers during the annealing step of the PCR reaction. The 5' end of the oligonucleotide probe contains the energy transfer donor fluorophore (reporter fluor) and the 3' end contains the energy transfer acceptor fluorophore (quenching fluor). In the intact oligonucleotide probe, the 3' quenching fluor quenches the fluorescence of the 5' reporter fluor. However, when the oligonucleotide probe is bound to the target nucleic acid, the 5' to 3' exonuclease activity of the DNA polymerase, e.g., Taq DNA polymerase, will effectively digest the bound labeled oligonucleotide probe during the amplification step. Digestion of the oligonucleotide probe separates the 5' reporter fluor from the blocking effect of the 3' quenching fluor. The appearance of fluorescence by the reporter fluor is detected and monitored during the reaction, and the amount of detected fluorescence is proportional to the amount of fluorescent product released. Examples of apparatus suitable for detection include, e.g. Applied Biosystems™ 7900HT real-time PCR platform and Roche's 480 LightCycler, the ABI Prism 7700 sequence detector using 96-well reaction plates or GENEAMP PC System 9600 or 9700 in 9600 emulation mode followed by analysis in the ABA Prism Sequence Detector or TAQMAN LS-50B PCR Detection System. The labeled probe facilitated multiplex Real Time-PCR/PCR can also be performed in other real-time PCR systems with multiplexing capabilities.

"Amplification" is a special case of nucleic acid replication involving template specificity. Amplification may be a template-specific replication or a non-template-specific replication (i.e., replication may be specific template-dependent or not). Template specificity is here distinguished from fidelity of replication (synthesis of the proper polynucleotide sequence) and nucleotide (ribo- or deoxyribo-) specificity. Template specificity is frequently described in terms of "target" specificity. Target sequences are "targets" in the sense that they are sought to be sorted out from other nucleic acid. Amplification techniques have been designed primarily for this sorting out.

The term "template" refers to nucleic acid originating from a sample that is analyzed for the presence of a molecule of interest. In contrast, "background template" or "control" is used in reference to nucleic acid other than sample template that may or may not be present in a sample. Background template is most often inadvertent. It may be the result of carryover, or it may be due to the presence of nucleic acid contaminants sought to be purified out of the sample. For example, nucleic acids from organisms other than those to be detected may be present as background in a test sample.

In addition to primers and probes, template specificity is also achieved in some amplification techniques by the choice of enzyme. Amplification enzymes are enzymes that, under the conditions in which they are used, will process only specific sequences of nucleic acid in a heterogeneous mixture of nucleic acid. Other nucleic acid sequences will not be replicated by this amplification enzyme. Similarly, in the case of T7 RNA polymerase, this amplification enzyme has a stringent specificity for its own promoters (Chamberlin et al. (1970) Nature (228):227). In the case of T4 DNA ligase, the enzyme will not ligate the two oligonucleotides or polynucleotides, where there is a mismatch between the oligonucleotide or polynucleotide substrate and the template at the ligation junction (Wu and Wallace (1989) Genomics (4):560). Finally, Taq and Pfu polymerases, by virtue of their ability to function at high temperature, are found to display high specificity for the sequences bounded and thus defined by the primers; the high temperature results in thermodynamic conditions that favor primer hybridization with the target sequences and not hybridization with non-target sequences (H. A. Erlich (ed.) (1989) PCR Technology, Stockton Press).

The term "amplifiable nucleic acid" refers to nucleic acids that may be amplified by any amplification method. It is contemplated that "amplifiable nucleic acid" will usually comprise "sample template." The terms "PCR product," "PCR fragment," and "amplification product" refer to the resultant mixture of compounds after two or more cycles of the PCR steps of denaturation, annealing and extension. These terms encompass the case where there has been amplification of one or more segments of one or more target sequences.

In some forms of PCR assays, quantification of a target in an unknown sample is often required. Such quantification is often in reference to the quantity of a control sample. The control sample DNA may be co-amplified in the same tube in a multiplex assay or may be amplified in a separate tube. Generally, the control sample contains DNA at a known concentration. The control sample DNA may be a plasmid construct comprising only one copy of the amplification region to be used as quantification reference. To calculate the quantity of a target in an unknown sample, various mathematical models are established. Calculations are based on the comparison of the distinct cycle determined by various methods, e.g., crossing points (CP) and cycle threshold values (Ct) at a constant level of fluorescence; or CP acquisition according to established mathematic algorithm.

The algorithm for Ct values in real time-PCR calculates the cycle at which each PCR amplification reaches a significant threshold. The calculated Ct value is proportional to the number of target copies present in the sample, and the Ct value is a precise quantitative measurement of the copies of the target found in any sample. In other words, Ct values represent the presence of respective target that the primer sets are designed to recognize. If the target is missing in a sample, there should be no amplification in the Real Time-PCR reaction.

Alternatively, the Cp value may be utilized. A Cp value represents the cycle at which the increase of fluorescence is highest and where the logarithmic phase of a PCR begins. The LightCycler® 480 Software calculates the second derivatives of entire amplification curves and determines where this value is at its maximum. By using the second-derivative algorithm, data obtained are more reliable and reproducible, even if fluorescence is relatively low.

The various and non-limiting embodiments of the PCR-based method detecting marker expression level as described herein may comprise one or more probes and/or primers. Generally, the probe or primer contains a sequence complementary to a sequence specific to a region of the nucleic acid of the marker gene. A sequence having less than 60% 70%, 80%, 90%, 95%, 99% or 100% identity to the identified gene sequence may also be used for probe or primer design if it is capable of binding to its complementary sequence of the desired target sequence in marker nucleic acid.

Some embodiments of the invention may include a method of comparing a marker in a sample relative to one or more control samples. A control may be any sample with a previously determined level of expression. A control may comprise material within the sample or material from sources other than the sample. Alternatively, the expression of a marker in a sample may be compared to a control that has a level of expression predetermined to signal or not signal a cellular or physiological characteristic. This level of expression may be derived from a single source of material including the sample itself or from a set of sources.

A sample for use in the methods herein may comprise a biological sample from a subject suspected of having or being at risk of having NME. The sample may be any suitable sample comprising nucleic acids used for various marker detection methods. For example, the sample may contain free or bound nucleic acids. The sample may contain whole cells which may be processed to make a cell lysate. In some embodiments, the marker detection methods may be performed on the cell lysate. In some embodiments, the nucleic acids may be extracted or further purified from the sample or the cell lysate for use with various marker detection methods.

Nucleic acids may include but need not be limited to RNA, cDNA, tRNA, mitochondrial DNA, plasmid DNA, siRNA, genomic DNA, or any other naturally occurring or artificial nucleic acid molecule. The sample may be any type of sample derived from the subject, including any body fluid or tissue that may contain one or more markers associated with the haplotype. Examples of sources of samples include, but are not limited to, biopsy or other in vivo or ex vivo analysis of prostate, breast, skin, muscle, fascia, brain, endometrium, lung, head and neck, pancreas, small intestine, blood, liver, testes, ovaries, colon, skin, stomach, esophagus, spleen, lymph node, bone marrow, kidney, placenta, or fetus. In some aspects of the invention, the sample comprises a fluid sample, such as peripheral blood, lymph fluid, ascites, serous fluid, pleural effusion, sputum, cerebrospinal fluid, amniotic fluid, lacrimal fluid, stool, urine, whole blood, serum, plasma, saliva, semen, vaginal fluid, pulmonary fluid, tears, perspiration, mucus and the like; an extract from a cell, chromosome, organelle, or membrane isolated from a cell; a cell; genomic DNA, RNA, or cDNA, in solution or bound to a substrate; a tissue; a tissue print, or any other material isolated in whole or in part from a living subject. Biological samples also include explants and primary and/or transformed cell cultures derived from patient tissues.

The subject may be any organism subject or susceptible to NME or MS including mammals, further including humans. The animal may be a canine such as a Pug Dog, Chihuahua, West Highland White Terrier, Pekingese, Labrador retriever, Golden retriever, Beagle, German shepherd, Dachshund, Yorkshire terrier, Boxer, Poodle, Shih tzu, Miniature schnauzer, Pomeranian, Cocker spaniel, Rottweiler, Bulldog, Shetland sheepdog, Boston terrier, Miniature pinscher, Maltese, German shorthaired pointer, Doberman pinscher, Siberian husky, Pembroke welsh corgi, Basset hound, Bichon frise, and other existing or non-existing breeds.

Examples of indirect methods of detection include any nucleic acid detection method including the following non-limiting examples, microarray analysis, RNA in situ hybridization, RNAse protection assay, Northern blot, reverse transcriptase PCR, quantitative PCR, quantitative reverse transcriptase PCR, quantitative real-time reverse transcriptase PCR, reverse transcriptase treatment followed by direct sequencing, direct sequencing of genomic DNA, or any other method of detecting a specific nucleic acid now known or yet to be disclosed. Other examples include any process of assessing protein expression including flow cytometry, immunohistochemistry, ELISA, Western blot, and immunoaffinity chromatograpy, HPLC, mass spectrometry, protein microarray analysis, PAGE analysis, isoelectric focusing, 2-D gel electrophoresis, or any enzymatic assay.

In Sanger Sequencing, a single-stranded DNA template, a primer, a DNA polymerase, nucleotides and a label such as a radioactive label conjugated with the nucleotide base or a fluorescent label conjugated to the primer, and one chain terminator base comprising a dideoxynucleotide (ddATP, ddGTP, ddCTP, or ddTTP, are added to each of four reaction (one reaction for each of the chain terminator bases). The sequence may be determined by electrophoresis of the resulting strands. In dye terminator sequencing, each of the chain termination bases is labeled with a fluorescent label of a different wavelength which allows the sequencing to be performed in a single reaction.

In pyrosequencing, the addition of a base to a single stranded template to be sequenced by a polymerase results in the release of a pyrophosphate upon nucleotide incorporation. An ATP sulfurylase enzyme converts pyrophosphate into ATP which in turn catalyzes the conversion of luciferin to oxyluciferin which results in the generation of visible light that is then detected by a camera or other sensor capable of capturing visible light.

In SOLID sequencing, the molecule to be sequenced is fragmented and used to prepare a population of clonal magnetic beads (in which each bead is conjugated to a plurality of copies of a single fragment) with an adaptor sequence and alternatively a barcode sequence. The beads are bound to a glass surface. Sequencing is then performed through 2-base encoding.

In massively parallel sequencing, randomly fragmented targeted DNA is attached to a surface. The fragments are extended and bridge amplified to create a flow cell with clusters, each with a plurality of copies of a single fragment sequence. The templates are sequenced by synthesizing the fragments in parallel. Bases are indicated by the release of a fluorescent dye correlating to the addition of the particular base to the fragment. Nucleic acid sequences may be identified by the IUAPC letter code which is as follows: A—Adenine base; C—Cytosine base; G—guanine base; T or U—thymine or uracil base. M-A or C; R-A or G; W-A or T; S-C or G; Y-C or T; K-G or T; V-A or C or G; H-A or C or T; D-A or G or T; B-C or G or T; N or X-A or C or G or T. Note that T or U may be used interchangeably depending on whether the nucleic acid is DNA or RNA. A sequence having less than 60%, 70%, 80%, 90%, 95%, 99% or 100% identity to the identifying sequence may still be encompassed by the invention if it is able of binding to its complimentary sequence and/or facilitating nucleic acid amplification of a desired target sequence. In some embodiments, the method may include the use of massively parallel sequencing, as detailed in U.S. Pat. Nos. 8,431,348 and 7,754,429, which are hereby incorporated by reference in their entirety.

Other methods used to assess expression and/or detect the presence/absence of a marker include the use of natural or artificial ligands having an affinity for a specific marker such that the ligands are capable of specifically binding the marker. For example, in some aspects, the natural and/or artificial ligands may comprise molecular probes that are capable of binding to the marker(s). Such ligands may also include antibodies, antibody complexes, conjugates, natural ligands, small molecules, nanoparticles, or any other molecular entity capable of specific binding to a marker. Antibodies may be monoclonal, polyclonal, or any antibody fragment including an Fab, F(ab)2, Fv, scFv, phage display antibody, peptibody, multispecific ligand, or any other reagent with specific binding to a marker. Ligands may be associated with a label such as a radioactive isotope or chelate thereof, dye (fluorescent or nonfluorescent,) stain, enzyme, metal, or any other substance capable of aiding a machine or a human eye from differentiating a cell expressing a marker from a cell not expressing a marker. In other words, in some embodiments, the molecular probes may comprise a label, with said label being selected from the non-exclusive list provided above. Additionally, expression may be assessed by monomeric or multimeric ligands associated with substances capable of killing the cell. Such substances include protein or small molecule toxins, cytokines, pro-apoptotic substances, pore forming substances, radioactive isotopes, or any other substance capable of killing a cell.

Other markers may also be used that are associated with the markers disclosed herein such as SNPs or other polymorphic markers that are in close enough proximity to have a statistically significant association with the marker disclosed herein (e.g., other markers in linkage disequilibrium with a marker disclosed herein). For example, if a marker or a close isoform thereof is detected in the subject, then the subject may be placed into a group either at higher or lower risk for NME depending on which marker or close isoform thereof is identified (i.e., a significant enough number of markers associated with a haplotype).

The disclosure also provides sets of molecular probes, as described above, for detection, including at least two probes capable of detecting, directly or indirectly, a marker disclosed herein associated with increased or decreased risk of NME, wherein the molecular probes are not associated with a microarray of greater than 1000 elements, a microarray with greater than 500 elements, a microarray with greater than 100 elements, a microarray with greater than 50 elements, or are not associated with a microarray. Such sets of two or more probes may include at least one probe capable of detecting, directly or indirectly, a marker disclosed herein associated with higher risk of developing NME and at least one other probe is capable of detecting, directly or indirectly, a marker disclosed herein associated with lower risk of developing NME. Moreover, as described above, the probes may comprise one or more labels selected from the non-exclusive list detailed above.

If a marker can be detected through expression level alteration, the expression of the marker in a sample may be compared to a level of expression predetermined to predict the presence or absence of a particular physiological characteristic. The level of expression may be derived from a single control or a set of controls. A control may be any sample with a previously determined level of expression. A control may comprise material within the sample or material from sources other than the sample. Alternatively, the expression of a marker in a sample may be compared to a control that has a level of expression predetermined to signal or not signal a cellular or physiological characteristic. This level of expression may be derived from a single source of material including the sample itself or from a set of sources. Comparison of the expression of the marker in the sample to a particular level of expression results in a prediction that the sample exhibits or does not exhibit the cellular or physiological characteristic.

Prediction of a cellular or physiological characteristic includes the prediction of any cellular or physiological state that may be predicted by assessing the expression of a marker. Examples include the identity of a cell as a particular cell including a particular normal or diseased cell type, the likelihood that one or more diseases is present or absent, the likelihood that a present disease will progress, remain unchanged, or regress, the likelihood that a disease will respond or not respond to a particular therapy, or any other disease outcome. Further examples include the likelihood that a cell will move, senesce, apoptose, differentiate, metastasize, or change from any state to any other state or maintain its current state.

One type of cellular or physiological characteristic is the risk that a particular disease outcome will occur. Assessing this risk includes the performing of any type of test, assay, examination, result, readout, or interpretation that correlates with an increased or decreased probability that an individual has had, currently has, or will develop a particular disease, disorder, symptom, syndrome, or any condition related to health or bodily state. Examples of disease outcomes include, but need not be limited to survival, death, progression of existing disease, remission of existing disease, initiation of onset of a disease in an otherwise disease-free subject, or the continued lack of disease in a subject in which there has been a remission of disease. Assessing the risk of a particular disease encompasses diagnosis in which the type of disease afflicting a subject is determined. Assessing the risk of a disease outcome also encompasses the concept of prognosis. A prognosis may be any assessment of the risk of disease outcome in an individual in which a particular disease has been diagnosed. Assessing the risk further encompasses prediction of therapeutic response in which a treatment regimen is chosen based on the assessment. Assessing the risk also encompasses a prediction of overall survival after diagnosis. Knowledge of the survival of the canine after diagnosis may be useful to inform veterinarians and/or owners about treatment such as immunosuppressive treatment, palliative treatment, or euthanasia. Additionally, knowledge of the risk of developing NME may inform breeders about whether to consider a canine as a potential candidate for breeding.

Determining whether or not the presence of an allele signifies a physiological or cellular characteristic may be assessed by any of a number of methods. The skilled artisan will understand that numerous methods may be used to select a marker or a plurality of markers that signifies a particular physiological or cellular characteristic. In diagnosing the presence of a disease, a threshold value may be obtained by performing the assay method on samples obtained from a population of patients having a certain type of disease (NME for example,) and from a second population of subjects that do not have the disease. In assessing disease outcome or the effect of treatment, a population of patients, all of which may develop a disease such as NME, may be followed for a period of time. After the period of time expires, the population may be divided into two or more groups. For example, the population may be divided into a first group of patients who did develop NME and a second group of patients who did not develop NME. Examples of endpoints include occurrence of one or more symptoms of disease, death or other states to which the given disease may progress. If presence of the marker in a sample statistically aligns with one group relative to the other group, the subject from which the sample was derived may be assigned a risk of having the same outcome as the patient group that differentially displays the marker.

Other methods may be used to assess how accurately the presence or absence of a marker signifies a particular physiological or cellular characteristic. Such methods include a positive likelihood ratio, negative likelihood ratio, odds ratio, and/or hazard ratio. In the case of a likelihood ratio, the likelihood that the presence or absence of the marker would be found in a sample with a particular cellular or physiological characteristic is compared with the likelihood that the presence or absence of the marker would be found in a sample lacking the particular cellular or physiological characteristic.

An odds ratio measures effect size and describes the amount of association or non-independence between two groups. An odds ratio is the ratio of the odds of a marker being present or absent in one set of samples versus the odds of the marker being present or absent in the other set of samples. An odds ratio of 1 indicates that the event or condition is equally likely to occur in both groups. An odds ratio grater or less than 1 indicates that presence or absence of the marker is more likely to occur in one group or the other depending on how the odds ratio calculation was set up.

A hazard ratio may be calculated by estimate of relative risk. Relative risk is the chance that a particular event will take place. It is a ratio of the probability that an event such as development or progression of a disease will occur in samples in which a particular marker is present over the probability that the event will occur in samples in which the particular marker is absent. Alternatively, a hazard ratio may be calculated by the limit of the number of events per unit time divided by the number at risk as the time interval decreases. In the case of a hazard ratio, a value of 1 indicates that the relative risk is equal in both the first and second groups; a value greater or less than 1 indicates that the risk is greater in one group or another, depending on the inputs into the calculation.

EXAMPLES

Various embodiments of the present teachings can be illustrated in the following non-limiting examples. The following examples are illustrative, and are not intended to limit the scope of the claims.

Example 1

Methods and Material
Study Population:
Purebred Pug dogs were used for the case-control genome-wide association study. Cases were verified to have NME based on clinical history and independent evaluation of hematoxylin and eosin brain sections by a veterinary neuropathologist. Cases ranged in age from 4 to 84 months (mean=18 months, median=26 months) and consisted of 11 males and 19 females. Control dogs had no evidence of neurological or autoimmune disease, ranged in age from 5 to 204 months (mean=60 months, median=48 months) at the time of sample collection and consisted of 30 males and 38 females. Control dogs were followed for 18 months after sample collection to verify that they did not develop neurological or autoimmune disease.

SNP Genotyping:
Genomic DNA was isolated using the Qiagen Gentra Puregene® Tissue Kit or Qiagen DNeasy® Blood and Tissue Kit (Qiagen N. V., Venlo, Netherlands). SNP genotyping was performed with the Illumina CanineHD Genotyping BeadChip using the Illumina BeadArray reader (Illumina Inc., San Diego, Calif.) following the manufacturer's protocol. Genomic DNA was isolated from 30 Pug dogs with histopathologically confirmed NME and 68 healthy, control Pug dogs without evidence of neurological or autoimmune disease. Genomic DNA quality was assessed with 2% agarose gel electrophoresis and quantified with fluorometric dsDNA quantification. Genome-wide association of >100,000 SNPs was performed using the Illumina Canine Infinium® HD BeadChip, and SNPs were analyzed with PLINK (found on the web at pngu.mgh.harvard.edu/purcell/plink/) with a minor allele frequency of >5% and call rate of >98%.

Statistical Analysis:
Genotyping was performed on 98 dogs, including 30 NME cases and 68 controls. Genome-wide analysis was performed with PLINK (Purcell et al. 2007). Concordance on duplicate samples was 99.96%. Only samples with a call rate of >95% were included, resulting in analysis of 28 NME cases and 66 controls. A total of 172,115 SNPs were genotyped. Classic multidimensional scaling (Purcell et al. 2007) using a call rate of >97% and MAF of >0.10 was performed on 85,366 SNPs to determine population stratification, and 21 controls that were not clustered with the main population of dogs were excluded resulting in a final population of 28 NME cases and 45 controls for analysis. These 45 control dogs ranged in age from 5 to 204 months (mean=80 months, median=48 months). Prior to analysis, 7,324 SNPs were excluded for failure to reach the call rate threshold (>95%) and 81,001 SNPs were excluded for failure to reach the MAF threshold (>0.05). In total, 86,692 SNPs were used for analysis. Bonferroni correction was applied to account for multiple hypothesis testing with a resulting P value of $5.77 \times 10^{-7}$ across 86,692 SNPs for genome-wide significance. To further evaluate genome-wide significance, MaxT permutation testing (Purcell et al. 2007) of 100 000 permutations was applied.

Example 2

Identifying Disease-Associated SNPs Genome-Wide
Initial genotyping was performed on 30 NME cases and 68 controls across 172,115 SNPs. After quality filtering and exclusion of population outliers, analysis of 28 NME cases and 45 controls across 86,692 SNPs identified two disease-associated loci that reached genome-wide significance with correction for multiple hypothesis testing. The strongest association was on chromosome 12 where 35 SNPs within the DLA class II region reached genome-wide significance after Bonferroni correction (raw P value for Bonferroni genome-wide significance is $p<5.77 \times 10^{-7}$) with the highest SNP having an odds ratio of 16.1 (95% CI: 4.7-55.5) (FIG. 3a and Table 1). FIG. 3 shows the genome-wide association results for 28 NME cases and 45 controls. In FIG. 3a, Fisher's exact tests were performed to compare SNP allele frequencies and negative log P values were plotted across the genome. The horizontal dotted line represents the threshold for significant association after Bonferroni correction of $-\log(P)>6.24$ with a strong peak on chromosome 12 maintaining genome-wide significance.

TABLE 1

SNPs with genome-wide significance after Bonferroni correction

| Canine SNP | Chr | Pos | $A_R/A_{NR}$ | $F_A/F_U$ | $P_{raw}$ | $P_{genome}$ | OR (95% CI) | Gene |
|---|---|---|---|---|---|---|---|---|
| CF2P178662 | 12 | 5166878 | A/G | 0.95/0.52 | $2.36 \times 10^{-6}$ | 0.0020 | 16.1 (4.7-55.5) | RT1-Db2 |
| BICF2S23225431 | 12 | 5217389 | G/A | 0.86/0.36 | $2.87 \times 10^{-9}$ | 0.0002 | 10.5 (4.4-25) | RT1-Db2 |
| BICF2P22942 | 12 | 5227499 | G/A | 0.86/0.36 | $2.87 \times 10^{-9}$ | 0.0002 | 10.5 (4.4-25) | RT1-Db2 |
| BICF2P194998 | 12 | 5275229 | A/T | 0.79/0.30 | $8.59 \times 10^{-9}$ | 0.0007 | 8.7 (4-19.2) | |
| rs8856588 | 12 | 5622709 | C/A | 0.79/0.30 | $8.59 \times 10^{-9}$ | 0.0007 | 8.7 (4-19.2) | COL11A2 |
| BICF2P574765 | 12 | 5710832 | A/G | 0.79/0.30 | $8.59 \times 10^{-9}$ | 0.0007 | 8.7 (4-19.2) | bing4-α |
| BICF2P1186632 | 12 | 5734305 | A/G | 0.79/0.29 | $7.24 \times 10^{-9}$ | 0.0006 | 8.9 (4.1-19.7) | TAPBP |
| BICF2P1185629 | 12 | 5791672 | G/A | 0.79/0.30 | $8.59 \times 10^{-9}$ | 0.0007 | 8.7 (4-19.2) | KIFC1 |
| BICF2P540937 | 12 | 5829667 | A/G | 0.79/0.32 | $6.27 \times 10^{-8}$ | 0.0054 | 7.9 (3.6-17.1) | CUTA |
| rs9189886 | 12 | 5843592 | G/C | 0.93/0.51 | $5.95 \times 10^{-8}$ | 0.0052 | 12.4 (4.1-37.3) | Syngap1 |
| rs9006653 | 12 | 5916360 | A/G | 0.79/0.33 | $8.07 \times 10^{-8}$ | 0.0070 | 7.5 (3.4-16.2) | Ppdpfb |
| BICF2P1200278 | 12 | 5931001 | G/A | 0.79/0.29 | $7.24 \times 10^{-9}$ | 0.0006 | 8.9 (4.1-19.7) | Ppdpfb |

TABLE 1-continued

SNPs with genome-wide significance after Bonferroni correction

| Canine SNP | Chr | Pos | $A_R/A_{NR}$ | $F_A/F_U$ | $P_{raw}$ | $P_{genome}$ | OR (95% CI) | Gene |
|---|---|---|---|---|---|---|---|---|
| rs9125534 | 12 | 5935549 | A/G | 0.79/0.30 | $8.59 \times 10^{-9}$ | 0.0007 | 8.7 (4-19.2) | Ppdpfb |
| BICF2S23322760 | 12 | 5992526 | A/G | 0.79/0.30 | $8.59 \times 10^{-9}$ | 0.0007 | 8.7 (4-19.2) | Ppdpfb |
| rs8760645 | 12 | 6024841 | T/A | 0.79/0.30 | $8.59 \times 10^{-9}$ | 0.0007 | 8.7 (4-19.2) | Ppdpfb |
| rs9245050 | 12 | 6028685 | G/A | 0.79/0.30 | $8.59 \times 10^{-9}$ | 0.0007 | 8.7 (4-19.2) | Ppdpfb |
| BICF2P863589 | 12 | 6059850 | A/G | 0.88/0.47 | $4.83 \times 10^{-7}$ | 0.0419 | 8 (3.3-19.7) | Ppdpfb |
| BICF2P1115728 | 12 | 6064245 | C/A | 0.88/0.47 | $4.83 \times 10^{-7}$ | 0.0419 | 8 (3.3-19.7) | Ppdpfb |
| BICF2P1254053 | 12 | 6149213 | G/A | 0.84/0.35 | $7.23 \times 10^{-9}$ | 0.0006 | 9.6 (6.4-22.2) | MLN |
| BICF2P402427 | 12 | 6160615 | A/C | 0.79/0.30 | $8.59 \times 10^{-9}$ | 0.0007 | 8.7 (4-19.2) | Ggnbp1 |
| rs8694179 | 12 | 6164202 | A/G | 0.84/0.35 | $7.23 \times 10^{-9}$ | 0.0006 | 9.6 (4.2-22.2) | Ggnbp1 |
| BICF2P459960 | 12 | 6184107 | G/A | 0.84/0.35 | $7.23 \times 10^{-9}$ | 0.0006 | 9.6 (4.2-22.2) | Ggnbp1 |
| BICF2S22951431 | 12 | 6197313 | A/C | 0.79/0.30 | $8.59 \times 10^{-9}$ | 0.0007 | 8.7 (4-19.2) | Ggnbp1 |
| BICF2P1261424 | 12 | 6200280 | G/A | 0.84/0.35 | $7.23 \times 10^{-9}$ | 0.0006 | 9.6 (4.2-22.2) | Ggnbp1 |
| rs9120943 | 12 | 6218850 | A/G | 0.84/0.35 | $7.23 \times 10^{-9}$ | 0.0006 | 9.6 (4.2-22.2) | |
| rs9077055 | 12 | 6238545 | A/G | 0.84/0.35 | $7.23 \times 10^{-9}$ | 0.0006 | 9.6 (4.2-22.2) | |
| rs8677516 | 12 | 6257019 | G/A | 0.86/0.36 | $2.87 \times 10^{-9}$ | 0.0002 | 10.5 (4.4-25) | |
| BICF2P608380 | 12 | 6289014 | G/A | 0.86/0.36 | $2.87 \times 10^{-9}$ | 0.0002 | 10.5 (4.4-25) | |
| rs9132539 | 12 | 6299459 | A/G | 0.79/0.30 | $1.96 \times 10^{-8}$ | 0.0017 | 8.5 (3.9-18.6) | |
| BICF2P1340012 | 12 | 6311277 | C/A | 0.79/0.30 | $8.59 \times 10^{-9}$ | 0.0007 | 8.7 (4-19.2) | |
| BICF2P1211546 | 12 | 6320910 | A/G | 0.79/0.30 | $8.59 \times 10^{-9}$ | 0.0007 | 8.7 (4-19.2) | |
| BICF2P738783 | 12 | 6342204 | A/C | 0.79/0.29 | $6.06 \times 10^{-9}$ | 0.0005 | 9.2 (4.1-20.3) | LOC1127664 |
| BICF2P1313789 | 12 | 6653816 | A/G | 0.79/0.34 | $1.89 \times 10^{-9}$ | 0.0163 | 7.1 (3.3-15.4) | NUDT3 |
| BICF2P1380652 | 12 | 6809061 | A/G | 0.79/0.33 | $8.07 \times 10^{-8}$ | 0.0070 | 7.5 (3.4-16.2) | SPDEF |
| BICF2P1462329 | 12 | 6832252 | A/G | 0.79/0.33 | $8.07 \times 10^{-8}$ | 0.0070 | 7.5 (3.4-16.2) | SPDEF |

In Table 1, Chr stands for chromosome; Pos stands for physical position; $A_R$, stands for risk allele; $A_{NR}$ stands for nonrisk allele; $F_A$ stands for allele frequency in cases; $F_U$ stands for allele frequency in controls; and OR stands for odds ratio.

Permutation testing using 100,000 permutations identified an additional four SNPs that reached genome-wide permuted significance within the DLA II locus and a second region of significance within the STYX gene on chromosome 8 ($P_{raw}$=2.11×10$^{-6}$, $P_{permuted}$=0.045) with an odds ratio of 5.9 (95% CI: 2.7-12.5) (FIG. 3b and Table 2). FIG. 3b showed that MaxT 100,000 permutation testing was performed and negative log P values were plotted across the genome. The horizontal dotted line represents the threshold for significant association after permutation testing of −log (P)>1.3 with one SNP on chromosome 8 maintaining permuted significance.

TABLE 2

New SNPs discovered with genome-wide significance after permutation testing

| Canine SNP | Chr | Pos | $A_R/A_{NR}$ | $F_A/F_U$ | $P_{raw}$ | $P_{permuted}$ | OR [95% CI] | Gene |
|---|---|---|---|---|---|---|---|---|
| BICF2S23516667 | 8 | 31971609 | A/G | 0.73/0.32 | $2.11 \times 10^{-6}$ | 0.0452 | 5.9 [2.8-12.5] | STYX |
| BICF2P639740 | 12 | 6686088 | G/A | 0.79/0.33 | $1.30 \times 10^{-7}$ | 0.0283 | 7.5 [3.4-16.4] | NUDT3 |
| BICF2P535495 | 12 | 6793393 | A/G | 0.79/0.33 | $1.30 \times 10^{-7}$ | 0.0453 | 7.5 [3.4-16.4] | MGC8455 |
| rs8957837 | 12 | 8822596 | C/G | 0.77/0.33 | $3.94 \times 10^{-7}$ | 0.0356 | 6.7 [3.1-14.6] | LOC112577 |

FIG. 1 showed all 38 SNPs in the DLA class II region of Chromosome12 with disease and non-disease associated alleles listed. FIG. 2 showed the sole SNP discovered in the STYX region on Chromosome 8, with disease and non-disease associated alleles listed. To account for the fact that several of the control dogs were younger than the mean age of disease onset at the time of sample acquisition, the data was re-analyzed excluding all control dogs less than 24 months of age. Both the DLA and chromosome 8 regions remained significant with Bonferroni correction and permutation testing, respectively, but the significance was not improved by this exclusion.

Example 3

Identifying Disease-Associated Haplotype Blocks Over the 4.1 MB Region of DLA II on Chromosome 12

Figure 4:
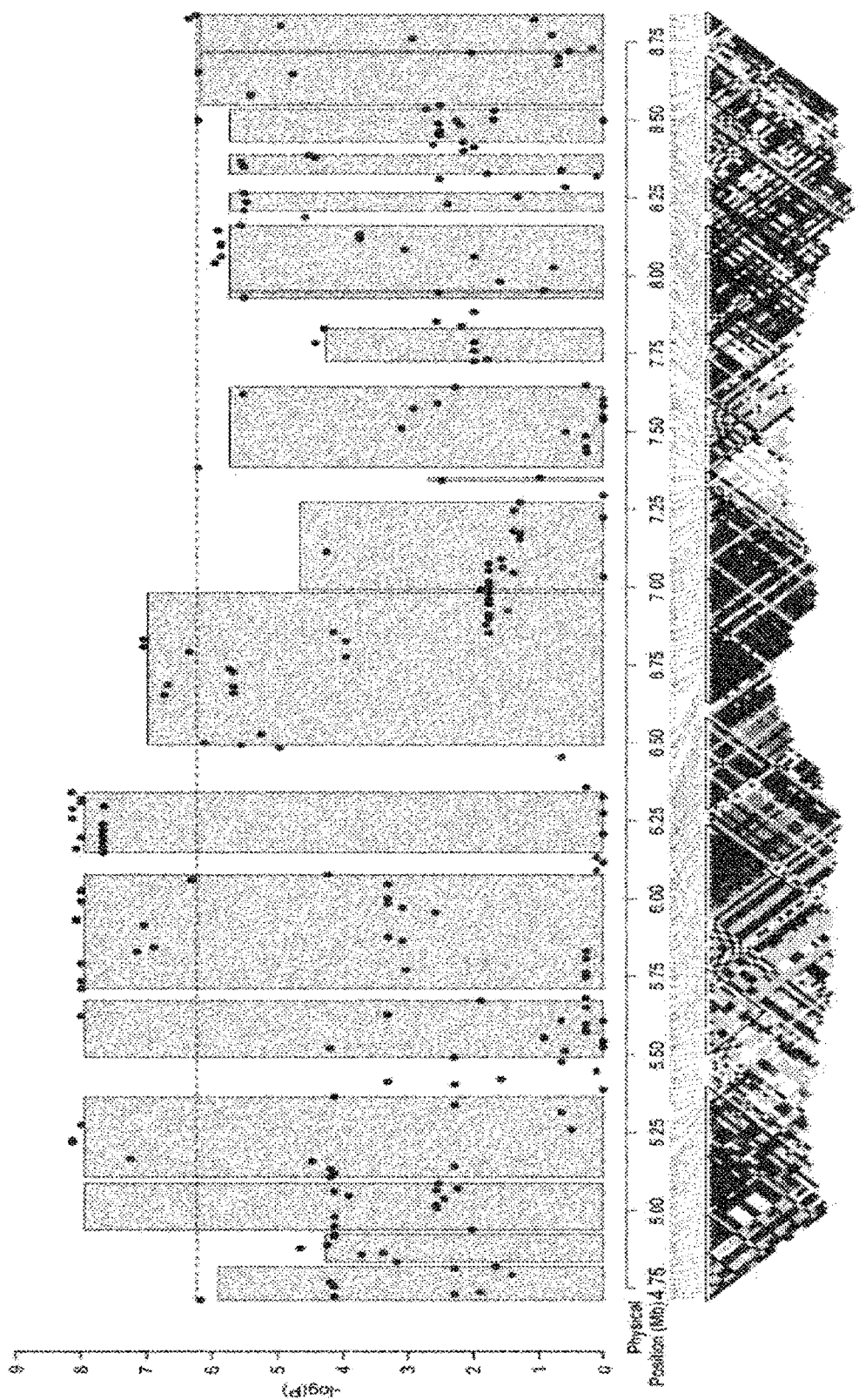
FIG. 4 depicts haplotype analysis of NME-associated DLA II locus on chromosome 12. A 4.1 Mb region located from positions 4,713,392 to 8,834,652 with 19 haplotype blocks generated in Haploview. Negative log P values from single SNP associations were derived from genome-wide analysis after removal of population outliers and individual SNPs were plotted as red circles. The horizontal dotted line represents the threshold for significant association after Bonferroni correction of $-\log(P)>6.24$.

Haplotype analysis using Haploview (Barrett et al. 2005) identified 19 haplotype blocks across a 4.1 Mb region of DLA II on chromosome 12, all of which were associated with an increased risk for developing NME with P values ranging from 2.1×10$^{-3}$ to 1.13×10$^{-8}$ (FIG. 4 and Table 3). This 4.1 Mb region located from positions 4,713,392 to 8,834,652 of the genomic DNA sequence on Chromosome 12 (SEQ ID NO:1, available in the canFam2 Canine genomic sequence database) was shown in FIG. 4 with 19 haplotype blocks generated in Haploview (Gabriel et al. 2002). Negative log P values from single SNP associations were derived from genome-wide analysis after removal of population outliers and individual SNPs were plotted as circles. The horizontal dotted line represents the threshold for significant association after Bonferroni correction of −log(P)>6.24. Each haplotype is described by a group of individual tagging SNP genotypes (or alleles) that are associated with risk. The presence of some or all of these alleles will determine the risk status. For example, the tagging SNPs in Table 1 that fall in a haplotype block in Table 3 can determine the presence of that block. Based on the tagging SNPs genotype, the risk status of the haplotype block can be determined. When look at the entire 4.1 Mb region, the presence of one or more risk associated haplotype blocks can determine the risk of NME. Further, among these 23 tagging SNPs for which the risk alleles are at position 6149213=G, 6160615=A, 6164202=A, 6184107=G, 6197313=A, 6200280=G, 6218850=A, 6238545=A, 6257019=G, 6289014=G, 6299459=A, 6311277=C, 6320910=A, and 6342204=A; Block 8 contains tagging SNPs for which the risk alleles are at position 6653816=A, 6686088=G, 6793393=A, 6809061=A and 6832252=A; and Block 19 contains tagging SNPs for which the risk allele is at position 8822596=C (see Table 1 and Table 3).

TABLE 3

19 Haplotype blocks generated by Haploview for DLA II region of Chr. 12

| Block | Haplotype | Population frequency | Case frequency | Control frequency | Start-end position | SEQ ID NO: |
|---|---|---|---|---|---|---|
| 1 | AAGGAGAAA | 0.59 | 0.84 | 0.43 | 4713392-4821633 | 3 |
| 2 | AGGCAAG | 0.60 | 0.80 | 0.47 | 4836721-4923170 | 4 |
| 3 | GCAGGAGGGGA | 0.49 | 0.79 | 0.30 | 4938082-5088561 | 5 |
| 4 | AAAACAGGAAGAG | 0.49 | 0.79 | 0.30 | 5108726-5364188 | 6 |
| 5 | AGAAAGCGA | 0.49 | 0.79 | 0.30 | 5491709-5672682 | 7 |
| 6 | AAGGAGAAAGAGAGAATGGACA | 0.49 | 0.79 | 0.30 | 5710832-6078099 | 8 |
| 7 | GAAGAGAAGGACAGA | 0.49 | 0.79 | 0.30 | 6149213-6342204 | 9 |
| 8 | GGAACAGGAAAAGAGAGGGCGAA | 0.51 | 0.79 | 0.33 | 6492201-6982375 | 10 |
| 9 | CGGGAAAAGGGGAGGC | 0.67 | 0.88 | 0.53 | 6992493-7270218 | 11 |
| 10 | AG | 0.73 | 0.88 | 0.64 | 7338759-7350261 | 12 |
| 11 | AAAAAG | 0.50 | 0.75 | 0.34 | 7384390-7643147 | 13 |
| 12 | AGGAGA | 0.70 | 0.89 | 0.58 | 7725530-7830733 | 14 |
| 13 | AG | 0.50 | 0.75 | 0.34 | 7927872-7944953 | 15 |
| 14 | AATAAAAGAGACGA | 0.50 | 0.75 | 0.34 | 7950821-8158994 | 16 |
| 15 | GGAGG | 0.50 | 0.75 | 0.34 | 8208369-8265940 | 17 |
| 16 | GCAAAG | 0.50 | 0.75 | 0.34 | 8327142-8386063 | 18 |
| 17 | GGCGAGCAAAA | 0.50 | 0.75 | 0.34 | 8429601-8533350 | 19 |
| 18 | ATGAACCG | 0.51 | 0.77 | 0.34 | 8546686-8713747 | 20 |
| 19 | GGCA | 0.51 | 0.77 | 0.34 | 8719506-8834652 | 21 | haplotype blocks (Table 3 and Table 4), Block 4 is further described, i.e. the risk status of the haplotype block can be determined, by a combination of tagging SNPs for which the risk alleles are at position 5166878=A, 5217389=G, 5227499=G and 5275229=A. Similarly, Block 5 contains tagging SNPs for which position the risk alleles are at 5622709=C; Block 6 contains tagging SNPs for which the risk alleles are at position 5710832=A, 5734305=A, 5791672=G, 5829667=A, 5843592=G, 5916360=A, 5931001=G, 5935549=A, 5992526=A, 6024841=T, 6028685=G, 6059850=A, 6064245=C; Block 7 contains Manually forcing all of these haplotype blocks into a single haplotype resulted in the creation of a 4.1 Mb haplotype containing 241 SNPs (SEQ ID NO: 1). This haplotype was common and strongly associated with an increased risk of developing NME at a case frequency of 85.1%, control frequency at 38.4% with significance p value at $7.97 \times 10^{-7}$. The strong association of the NME disease with DLA II supports an autoimmune etiology. Haplotype analysis of the DLA II region identified a large, common block strongly associated with altered disease risk. Polygenic loci with MHC II polymorphisms show the strongest disease association, as observed between DLA II and NME association.

Example 4

Identifying Disease-Associated Haplotype Blocks Over the 488 kb Region of STYX on Chromosome 8

Figure 5:
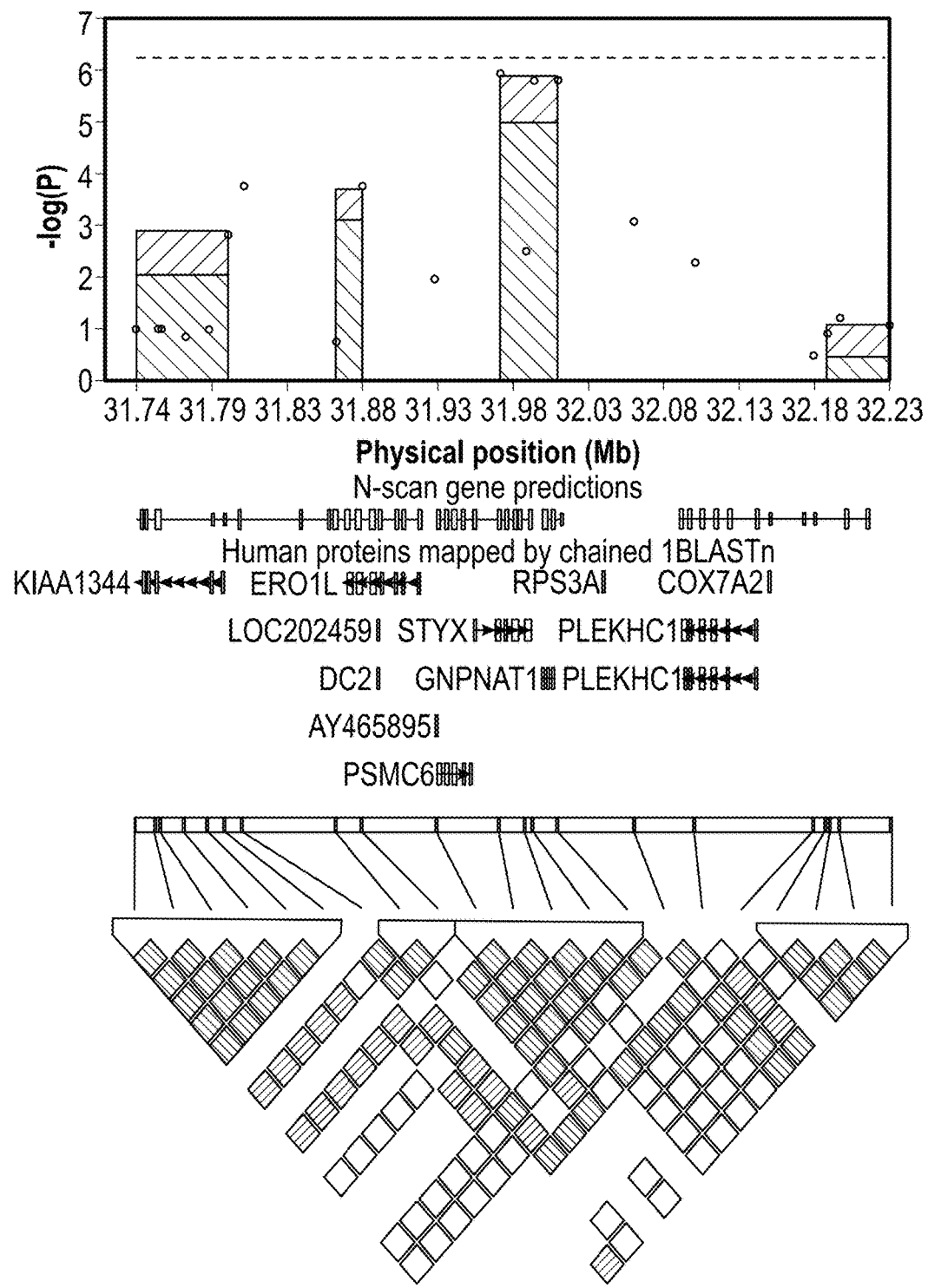
FIG. 5 depicts haplotype analysis of NME-associated locus on chromosome 8. A 488 kb region located from positions 31,736,206 to 32,225,068 is shown with 4 haplotype blocks generated in Haploview. Negative log P values from single SNP associations were derived from genome-wide analysis after removal of population outliers and individual SNPs were plotted as red circles. The horizontal dotted line represents the threshold for significant association after Bonferroni correction of $-\log(P)>6.24$. The additional blue region within each haplotype block represents MaxT 100,000 permuted haplotypes.

Haplotype analysis of the STYX region of chromosome 8 identified four haplotypes (FIG. 5 and Table 4). A 488 kb region located from positions 31,736,206 to 32,225,068 of the genomic DNA sequence (SEQ ID NO: 2, available in the canFam2 Canine genomic sequence database) is shown in FIG. 5 with 4 haplotype blocks generated in Haploview. Negative log P values from single SNP associations were derived from genome-wide analysis after removal of population outliers and individual SNPs were plotted as circles. The horizontal dotted line represents the threshold for significant association after Bonferroni correction of $-\log(P) > 6.24$. The additional shaded region within each haplotype block represents MaxT 100,000 permuted haplotypes.

TABLE 4

Haplotype blocks generated by Haploview for STYX region of Chr.8

| Block | Haplotype | Population frequency | Case frequency | Control frequency | Start position | End Position | SEQ ID NO: |
|---|---|---|---|---|---|---|---|
| 20 | GAAGGG | 0.74 | 0.59 | 0.83 | 31736206 | 31795128 | 22 |
| 21 | AG | 0.47 | 0.27 | 0.59 | 31866373 | 31883390 | 23 |
| 22 | GGAG | 0.52 | 0.27 | 0.68 | 31971609 | 32009283 | 24 |
| 23 | AGAA | 0.50 | 0.59 | 0.44 | 32183184 | 32225068 | 25 |

The most significantly associated and common haplotype spanned the STYX and GNPNAT1 genes and was protective based on phenotype ($P=1.43\times10^{-6}$). This block also contained two additional haplotypes significantly associated with NME risk (p~0.005, data not shown).

STYX, (serine/threonine/tyrosine interacting protein) is a pseudophosphatase that lacks intrinsic catalytic activity and is structurally similar to members of the dual-specificity phosphatase subfamily of protein tyrosine phosphatases. Protein tyrosine phosphatases play a key role in immune system function including lymphocyte activation, with mutations in PTPN22 having been documented in association with autoimmunity (Vang et al. 2005). STYX also is known to bind to the calcineurin substrate CRHSP-24, and calcineurin plays an important role in T cell activation. Dephosphorylation of CRHSP-24 can be prevented by administration of the immunomodulatory drugs cyclosporine and FK506.

GNPNAT1, glucosamine-phosphate N-acetyltransferase 1, is involved in amino sugar metabolism including the formation of uridine diphospho-N-acetylglucosamine (UDP-GlcNAc). UDP-GlcNAc is an important cellular metabolite necessary for the synthesis of of N-linked and O-linked glycans that play important roles in normal thymic T-cell apoptosis. The disruption of GNPNAT1 is expected to lead to aberrant immune responses in NME.

The purpose of this investigation was to identify disease susceptibility loci for NME through genome-wide association (GWA) of single nucleotide polymorphisms (SNPs) in affected and non-affected Pug dogs. 170,000 SNPs, genome-wide association was performed on a small number of case and control dogs to determine disease susceptibility loci in canine necrotizing meningoencephalitis (NME), a disorder with known non-Mendelian inheritance that shares clinical similarities with atypical variants of multiple sclerosis in humans. Genotyping of 30 NME-affected Pug dogs and 68 healthy, control Pugs identified two loci associated with NME, including a region within dog leukocyte antigen class II on chromosome 12 that remained significant after Bonferroni correction. Our results support the utility of this high density SNP array, confirm that dogs are a powerful model for mapping complex genetic disorders and provide important preliminary data to support in depth genetic analysis of NME in numerous affected breeds.

Example 5

Identifying Disease-Associated Indels Over the 4.1 MB Region of DLA II on Chromosome 12

Next-generation whole genome sequencing utilizing the Illumina chemistry (Illumina, San Diego, Calif.) was performed to identify a functional variant within the 4.1 Mb associated haplotype on chromosome 12. Three neuropathologically verified affected pugs and two closely matched unaffected pugs over the age of 6 years were used for the sequencing. The genomes of the five dogs were sequenced to an average coverage of 13.5× and, averagely, 5 million SNPs and small indel variants per animal were identified. Among these SNPs and indels, a single base deletion causing a frame shift in the major histocompatibility complex, class II, DP beta 1 (HLA-DPB1; human leuokocyte antigen-DPB1) gene was discovered. This particular HLA-DPB1 single base deletion is located at 333 KB downstream from the most strongly associated SNP previously identified, BICF2P194998. The HLA-DPB1 deletion variant is represented by SEQ ID NO: 26 (5'-TCTTCGCGCAATTG-GACAGCGCGGCGGGGGTGTTCGCGGCCG TGTCGAGCTGGGCC GAGTAACTGCCAGGAACTG-GAACGTCCCCGG-3'), and a "C" is deleted at Chromosome 12 position 5608903, in comparison to the HLA-DPB1 wild type (UniProKB/Swiss-Prot No: P04440) represented by SEQ ID NO: 27 (5'-TCTTCGCGCAATTGGACA-GCGCGGCGGGGGTGTTCGCGGCCG TGTCCGAGCTGGGC CGAGTAACTGCCAGGAACTG-GAACGTCCCCGG-3'). This HLA-DPB1 deletion variant is in haplotype Block 5.

Example 6

HLA-DPB1 Deletion Variant Confirmation

The Sanger sequencing was performed on 93 pugs (26 post-mortem confirmed NME cases and 67 unaffected controls) to test if the HLA-DPB1 deletion variant was more strongly associated with NME than the previously genotyped SNPs. The P-values and odds ratios were calculated by Fisher's exact allelic tests to demonstrate the strength of NME association. Fisher's exact allelic tests showed that the HLA-DPB1 deletion was more strongly associated with NME with 1.285e-15, OR 23.2 (86.5% frequency in all cases and 21.6% in controls). The deletion variant in HLA-DPB1 is therefore the leading candidate for the functional variant within the DLA locus associated with genetic risk for NME in the pug. The deletion variant was found in 22 out of 60 investigated control dogs over 6 years of age and was found in all case dogs that were histopathologically confirmed, and such finding further indicated the non-Mendelian inheritance pattern of NME in those animals.

HLA-DPB1 belongs to the HLA class II beta chain paralogues. This class II molecule is a heterodimer consisting of an alpha (DPA) and a beta chain (DPB), both anchored in the membrane. Class II molecules are expressed in antigen presenting cells (APC) such as, B lymphocytes, dendritic cells, macrophages. HLA-DPB1 binds peptides derived from antigens that access the endocytic route of APC and presents them on the cell surface for recognition by the CD4 T-cells. HLA-DPB1 variants have been linked to multiple human disorders with autoimmune associations including lupus, multiple sclerosis, and Graves' disease. This particular HLA-DPB1 single base deletion located at 333 KB downstream from NME associated SNP BICF2P194998 enables development of further diagnostic tests, treatment approaches within the pug, and a further investigation of haplotype positive animals as possible models for human autoimmune diseases.

Example 7

Materials and Methods
Diagnosis:

Affected dogs included 8 Malteses with histopathologically confirmed NME disease and 3 with a diagnosis based on clinical presentation, magnetic resonance imaging, and cerebrospinal fluid analysis. Control Maltese dogs had no evidence of neurological or autoimmune disease at the time of sample collection.

In addition to Maltese, 16 case (i.e., afflicted with NME) and 9 control Chihuahua and 34 case and 88 control Pug, were studied for meta-analysis. The Pug dogs are an expansion of the dataset used by R M Barber et al., Identification of risk loci for necrotizing meningoencephalitis in Pug dogs, J. Hered. (102) Suppl:S40-6 (2010). The Chihuahua cases were histopathologically confirmed and the controls had no evidence of neurological or autoimmune disease at the time of sample collection.

Genotyping:

DNA samples were either extracted from blood, saliva or formalin-fixed tissue sections embedded in paraffin. Genomic DNA was extracted from the EDTA blood samples using the DNeasy extraction kit (Qiagen, Venlo, Netherlands). Saliva samples were extracted using the Oragene Saliva extraction protocol (DNA Genotek, Kanata, Canada) and the FFPE tissues were extracted using the QIAamp DNA FFPE Tissue Kit (Qiagen, Venlo, Netherlands), followed by Ovation whole genome amplification (Ovation WGA FFPE system; NuGEN, San Carlos, USA). Samples were genotyped using the CanineHD beadchip, following manufacturer's instructions (Illumina Inc, San Diego, USA).

Figure 6:
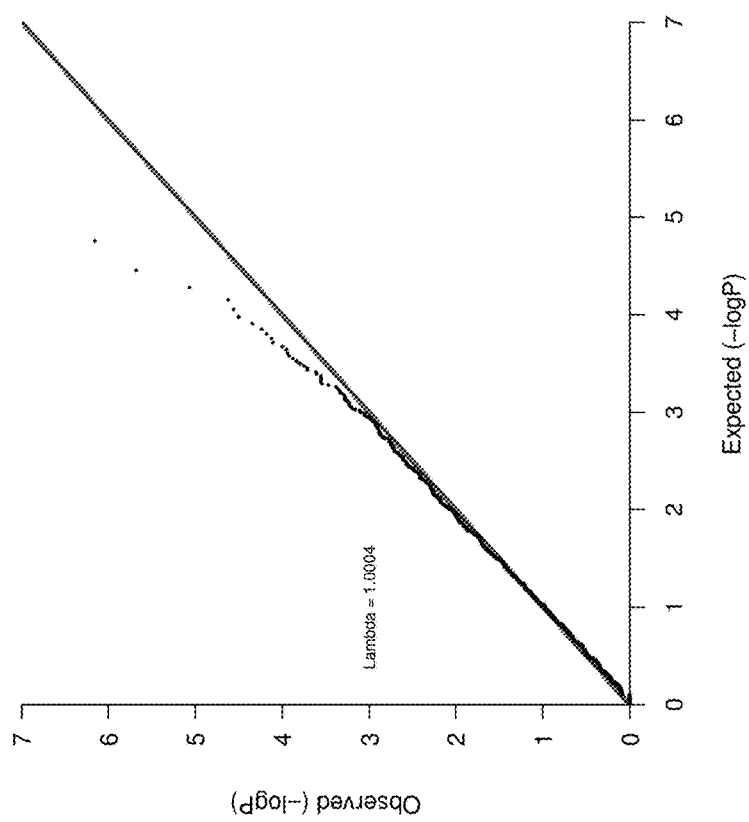
FIG. 6 is a QQ plot of the Maltese population used in the experiments detailed herein.

Statistical Analysis:

A total of 173662 SNPs were genotyped on 11 NME cases and 38 controls. Genome-wide analysis was performed with plink v1.07 (S. Purcell *PLINK: a tool set for whole-genome association and population-based linkage analyses*, Am. J. Hum. Genet. (81) 559-75 (2007)). Pairwise IBD estimation was done to remove possibly related dogs (Pi_hat score >0.5 were excluded), leading to the exclusion of 1 control (Pi_hat score: 0.64). Next, multidimensional scaling (MDS) with a minor allele frequency (MAF) of <0.10 and genotype frequency >97% was performed to determine population stratification, and 2 controls that were not clustered with the main population of dogs were excluded resulting in a final population of 11 NME cases and 35 controls for analysis. Further testing of population stratification was done on this sample set by plotting a QQplot of observed against expected p-values, resulting in a genomic inflation factor of 1.025, or 1.0004 when corrected for the two associated regions (FIG. 6), demonstrating no significant population stratification in the sample set. The Pug and Chihuahua populations after quality control and MDS consisted of 32 case 44 control Pugs and 16 case and 9 control Chihuahua.

All samples had a call rate of >80% and were included in the analysis. After excluding SNPs<97% and MAF>0.10, HWE>0.001, and SNPs on the X and Y chromosomes, a total of 57222 SNPs were analyzed. A bonferroni correction for multiple testing was performed with a resulting P value of $8.7 \times 10^{-7}$ across 57222 SNPs for genome-wide significance. To further evaluate genome-wide significance MaxT permutation testing of 10 000 permutations was applied and a FDR correction was applied (Benjamini & Hochberg (1995) step-up FDR control). All plots were created using 82.15.3 (packages qqman and ggplot2).

Meta-Analysis:

To calculate the common effect size of the SNPs across the different populations, meta-analysis and corresponding forest plots were done using the R package Rmeta and R2.15.3 on the Maltese, Chihuahua and Pug populations. The common OR was estimated by a logistic regression model with origin and genotype as independent variables, and outcome as dependent variable (the Mantel-Haenszel method). In addition, genome wide meta-analysis was performed using plink v1.07. Power calculations were done using the genetic power calculator, assuming 29% carrier frequency, a relative risk of 5.45 in the homozygotes, a disease frequency of 1% and considering unscreened random controls (KA Greer et al., Necrotizing meningoencephalitis of Pug dogs associates with dog leukocyte antigen class II and resembles acute variant forms of multiple sclerosis, Tissue Antigens (76) 110-118 (2010)).

Association Testing

Association testing in the Maltese revealed two regions that reach genome wide significance: Chr4: 74522353T>A p=$8.07 \times 10^{-7}$, and chr15: 53338796A>G p=$1.55 \times 10^{-7}$ (Table 1 and FIG. 2). All genes in these regions were then prioritized based on ENDEAVOUR gene prioritization with a training set of human MS genes (L-C Tranchevent et al., ENDEAVOUR update: a web resource for gene prioritization in multiple species, Nucleic Acids Res. (36) W377-384 (2008).

Figure 12A:
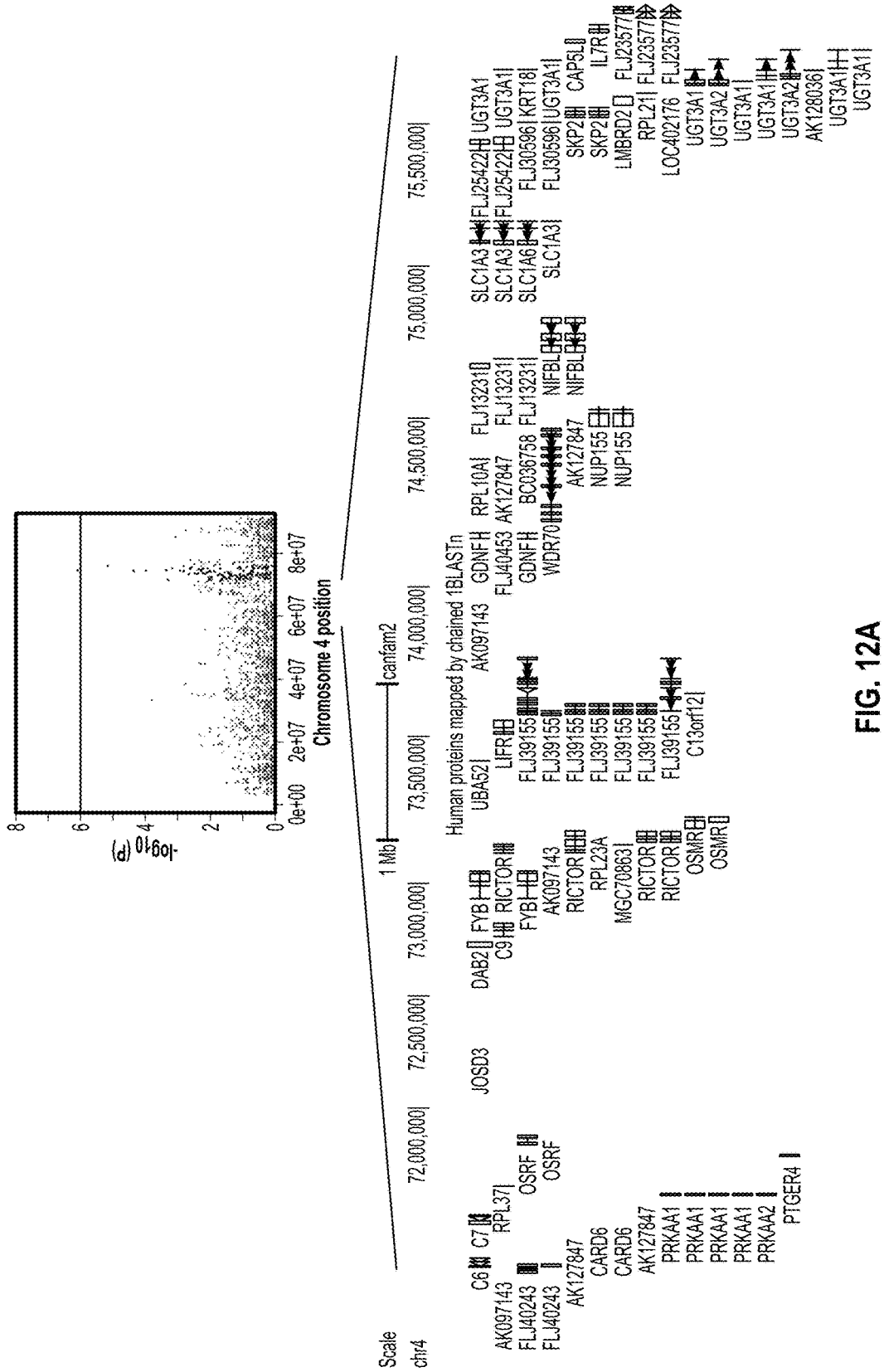
FIGS. 12A and 12B are a series of regional Manhattan plots for the regions on chr4 and chr15, respectively, and the genes located in these regions. The associated region is highlighted in blue. The horizontal grey line represents the threshold for significant association after Bonferroni correction.
Figure 12B:
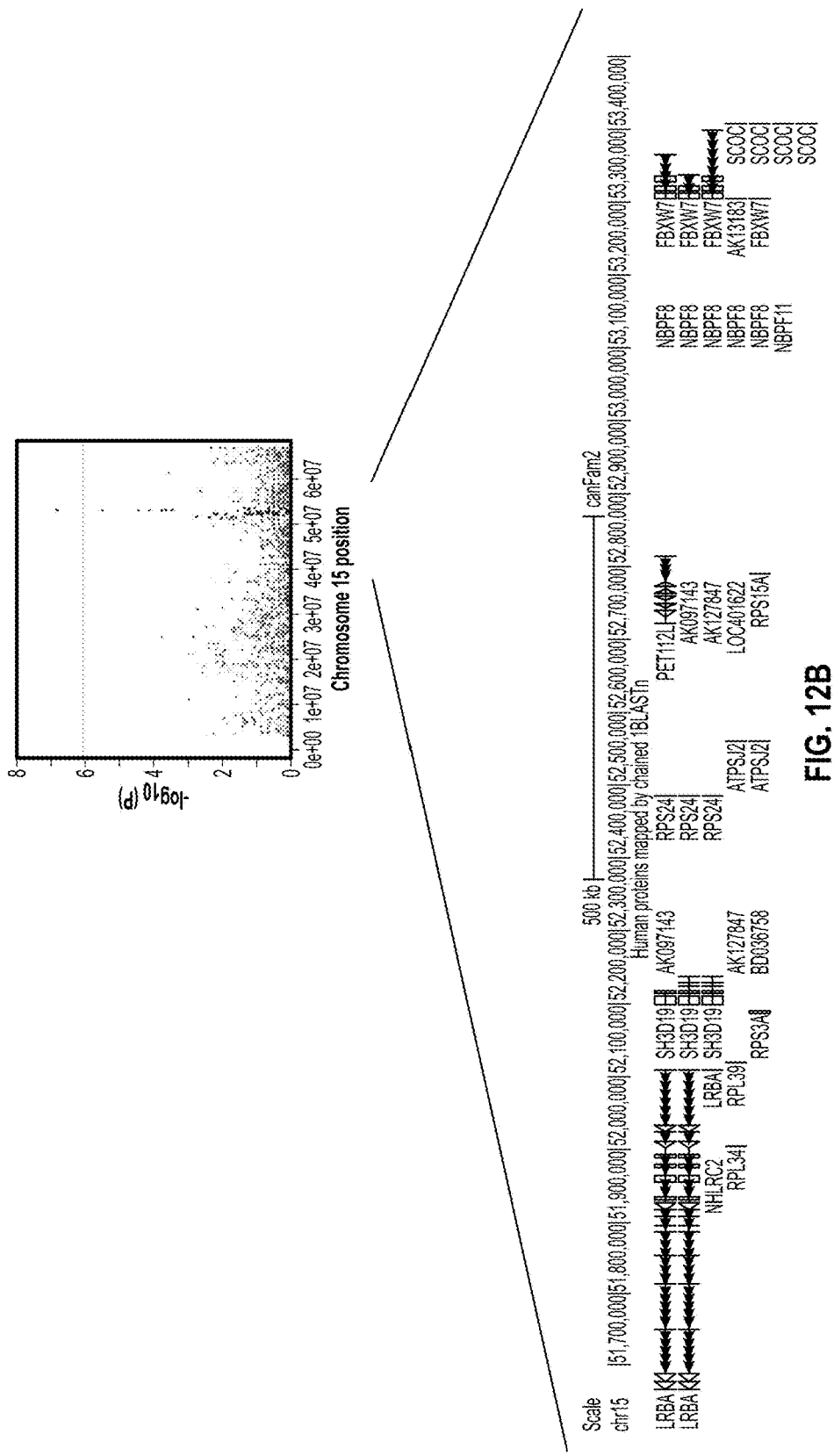

The following genes were prioritized in each region: IL7R (encodes for the IL7 receptor alpha chain) and FBXW7α, which can be found on chromosomes 4 and 15, respectively (Table 2 and FIGS. 12A and 12B). None of the SNPs in the Chihuahua population reached genome wide significance, due to low sample size. 139 SNPs and 237 in the IL7R region were also genotyped in the Chihuahua and Pug respectively, but only 5 reached nominal significance in each (p<0.05). 55 and 75 SNPs were genotyped in the region on chr15 in the Chihuahua and Pug respectively, and 3 (5.5%) and 18 (24%) reached nominal significance respectively. In the Pug, this is much higher than expected (5%).

TABLE 1

| Chr | Position | SNP | $P_{raw}$ | BONF | FDR_BH | Max(T) | AF cases | AF control | OR | L95 | U95 |
|---|---|---|---|---|---|---|---|---|---|---|---|
| 4 | 74332455 | BICF2G630168115 | 4.52E-05 | 1.000 | 0.157 | 0.696 | 0.82 | 0.31 | 9.818 | 2.972 | 32.440 |
| 4 | 74457236 | BICF2G630168169 | 4.52E-05 | 1.000 | 0.157 | 0.696 | 0.82 | 0.31 | 9.818 | 2.972 | 32.440 |
| 4 | 74522353 | BICF2G630168244 | 8.07E-07 | 0.039 | 0.013 | 0.027 | 0.91 | 0.31 | 21.820 | 4.684 | 101.600 |
| 4 | 75929427 | BICF2P1021800 | 7.16E-06 | 0.348 | 0.058 | 0.199 | 0.00 | 0.49 | 0 | | |
| 15 | 53260054 | BICF2P1314960 | 3.52E-05 | 1.000 | 0.156 | 0.593 | 0.45 | 0.04 | 18.270 | 4.269 | 78.200 |
| 15 | 53272289 | BICF2P956368 | 3.19E-06 | 0.155 | 0.031 | 0.097 | 0.50 | 0.04 | 22.330 | 5.361 | 93.040 |
| 15 | 53338796 | rs8954494 | 1.55E-07 | 0.008 | 0.008 | 0.005 | 0.60 | 0.04 | 33.500 | 7.763 | 144.600 |

Table 1: Top 3 SNPs from each of the associated regions; Praw: Fisher exact test p-value. BONF: Bonferroni correction for multiple testing. FDR: False discovery rate of multiple testing; Max(T): Max(T) permutation of 10000 permutations. EMP2 value; AF: Allele frequency; L95: OR: Odds ration; 95% CI lower boundary; U95: 95% CI. Coordinates are based on CanFam2.0 alignment.

TABLE 2

Table 2: Human proteins mapped to the 2 identified regions in the canine genome (tBlastN).

| chr4 | chr15 |
|---|---|
| AK097143 | AK097143 |
| AK127847 | AK127847 |
| AK128036 | AK131383 |
| BC036758 | ATP5J2 |
| C13orf12 | BC036758 |
| C6 | FBXW7 |
| C7 | LOC401622 |
| C9 | LRBA |
| CAPSL | NBPF11 |
| CARD6 | NBPF8 |
| DAB2 | NHRC2 |
| FLJ13231 | PET112L |
| FLJ23577 | RPL34 |
| FLJ25422 | RPL39 |
| FLJ30596 | RPS15A |
| FLJ39155 | RPS24 |
| FLJ40243 | RPS3A |
| FLJ40453 | SCOC |
| FYB | SH3D19 |
| GDNF | |
| IL7R | |
| JOSD3 | |
| KRT18 | |
| LIFR | |
| LMBRD2 | |
| LOC402176 | |
| MGC70863 | |
| NIPBL | |
| NUP155 | |
| OSMR | |
| OSRF | |
| PRKAA1 | |
| PTGER4 | |
| RICTOR | |
| RPL10A | |
| RPL21 | |
| RPL23A | |
| RPL37 | |
| SKP2 | |
| SLC1A3 | |
| UBA52 | |
| UGT3A1 | |
| UGT3A2 | |
| WDR70 | |

Next, the dog leukocyte antigen (DLA) II locus on chr12:4,713,392-8,834,652 in the Maltese (FIG. 8) and the Chihuahua (FIG. 9) were analyzed. Of the 122 SNPs genotyped in this area in the Maltese, 17 (13.9%) were significant (p<0.05), which is higher than expected (5%). The most significant SNP is: BICF2P178662 chr12:5166878 (p=0.001) (FIG. 10). In the Chihuahua, 120 SNPs were genotyped that passed quality control, of which 8 are significant (6.6%). The most significant SNP is: BICF2P608380 chr12: 6289014 (p=0.006) (FIG. 10). 13 SNPs and 9 SNPs were analyzed in the region associated with NME in the Pug dog on chr8 (chr8:31736206-32225068) in the Maltese and Chihuahua respectively, but none of SNPs reached significance.

Meta-Analysis of the DLA II Region in the Pug, Maltese and Chihuahua

To look more closely to the DLAII region, a meta-analysis was performed on the SNPs in the DLAII locus and the Maltese population, a Chihuahua population and an expanded Pug population of the population described previously R M Barber et al., Identification of risk loci for necrotizing meningoencephalitis in Pug dogs, J. Hered. (102) Suppl:S40-6 (2010). FIG. 10 shows the SNPs that were most significant in the Pug (BICF2P738783, BICF2P22942), Maltese (BICF2P178662) and Chihuahua (BICF2P608380) that were genotyped and passed QC in all 3 cohorts. The effect sizes are similar between all populations. Power calculations show that the Maltese and Chihuahua data-sets have respectively 52% and 38% power to detect the previous effect present in the Pug when using an allelic test (K A Greer et al., Necrotizing meningoencephalitis of Pug dogs associates with dog leukocyte antigen class II and resembles acute variant forms of multiple sclerosis, Tissue Antigens (76) 110-118 (2010); and S Purcell et al., Genetic Power Calculator: design of linkage and association genetic mapping studies of complex traits, Bioinformatics (19) 149-150 (2003)). In addition, a meta-analysis was also performed on SNPs from the chr7 and chr15 region, which also demonstrated a similar effect size in all breeds for the region on chr15 (FIG. 11). Meta-analysis across the entire genome designated the HLAII regions as genome wide significant (p=1.18×10$^{-8}$), followed by the region on chr15 (p=2.23×10$^{-6}$).

Figure 7:
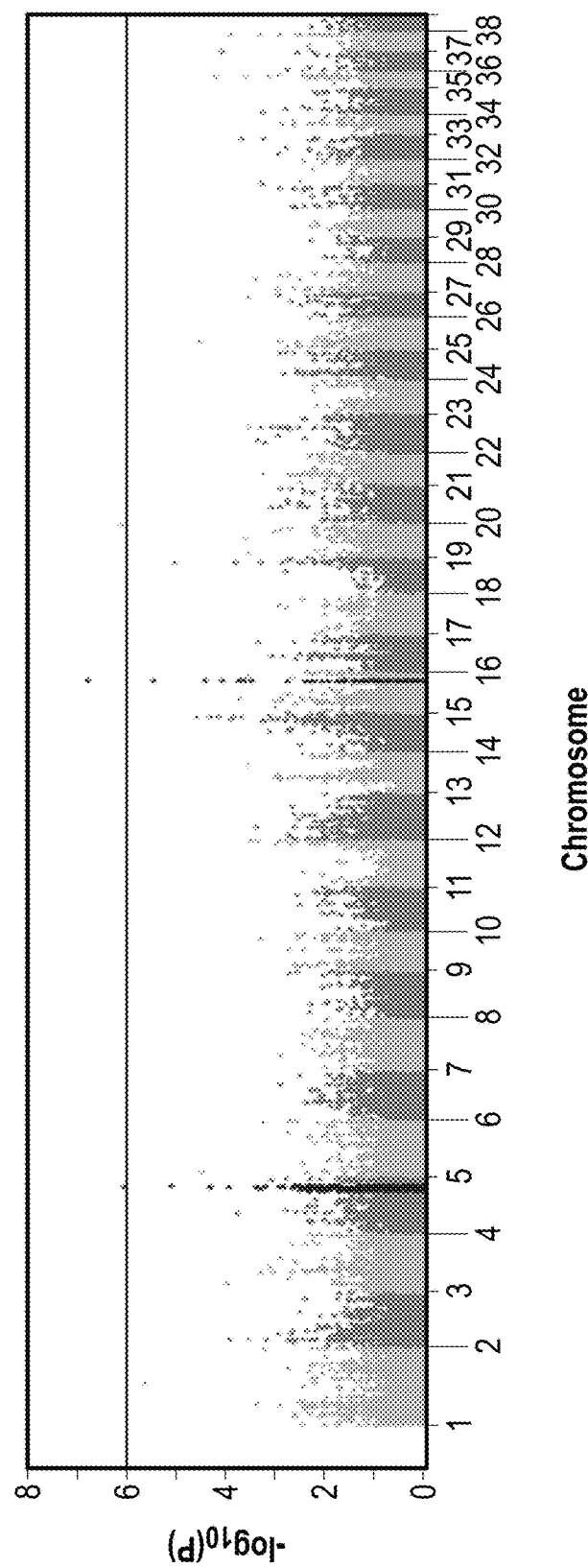
FIG. 7 is a Manhattan plot of the Maltese population in which regions that reach genome wide significance are indicated in black. The horizontal grey line represents the threshold for significant association after Bonferroni correction.

Overall, a genome wide association study in the Maltese dog was performed to identify susceptibility loci for NME. As described above, the study 2 risk loci associated with disease (FIG. 7), on chr4 and chr15.

The region on chr4 spreads about 10 Mb, with the highest significance between chr4: 71506894-75929427 (4.4 Mb). About 44 human proteins map to this region in the canine genome (tBlastN) (Table 2). The most significant gene of interest/marker in this region is IL7R (encodes for the IL7 receptor alpha chain), which is located about 68,000 bp from significant marker BICF2P1021800 (Table 1). Polymorphisms in IL7R, have been demonstrated to contribute to the non-HLA genetic risk in multiple sclerosis in humans. In addition, an altered expression of the genes encoding IL7Ralpha and its ligand, IL7, has been found in the cerebrospinal fluid compartment of individuals with multiple sclerosis (F. Lundmark et al., Variation in interleukin 7 receptor alpha chain (IL7R) influences risk of multiple sclerosis, Nature Genetics (39) 1108-1113 (2007)). IL7R is a member of the type I cytokine receptor family, an important immune system regulator and important in the proliferation and survival of T and B lymphocytes.

The second region on chr15 spreads about 1.9 Mb at chr15:51567064-53471253 and 19 human proteins map to this region (Table 2). An interesting gene in this region is FBXW7, which is an important attenuator of inflammatory signaling. FBXW7α regulates CCAAT enhancer binding protein-delta (C/EBPδ), by its requirement for ubiquitination and degradation of C/EBPδ. C/EBPδ binding to its own promoter increases when FBXW7α is silenced. C/EBPδ is a transcription factor that regulates inflammatory processes mediating bystander neuronal injury and CNS autoimmune inflammatory disease. Data from experiments performed in mice lacking C/EBPδ suggest that C/EBPδ may have a role in systemic inflammatory diseases such as multiple sclerosis. Mice deficient in C/EBPδ expression exhibited less severe clinical disease than wild-type littermates in response to induction of experimental autoimmune encephalomyelitis (EAE) by vaccination with a myelin oligodendrocyte glycoprotein (MOG) fragment.

Another interesting gene is LRBA. Deleterious mutations in LRBA have been associated with a syndrome of immune deficiency and autoimmunity. By performing meta-analysis, similar effect sizes were found for this region in the Pug, Chihuahua and Maltese, and an enrichment of nominal associated SNPs in the Pug. This suggests this region might also be important in other Toy breeds (FIG. 11).

Figure 8:
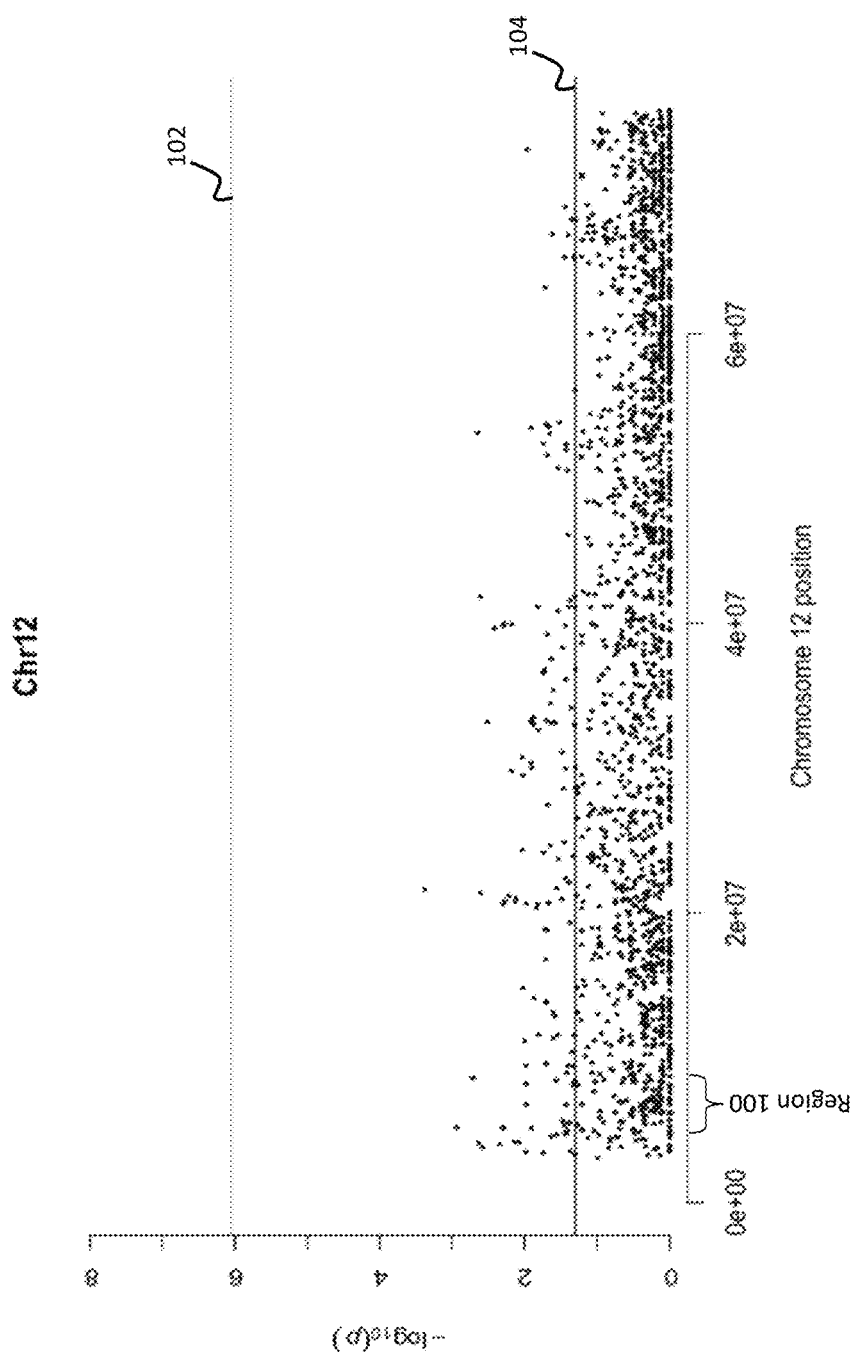
FIG. 8 is a regional Manhattan plot for the DLA II region on chromosome 12 (chr12) in the Maltese. The associated region is labeled Region 100. The horizontal grey line labeled 102 represents the threshold for significant association after Bonferroni correction. The line labeled 104 represents a p=0.05 cut-off.
Figure 9:
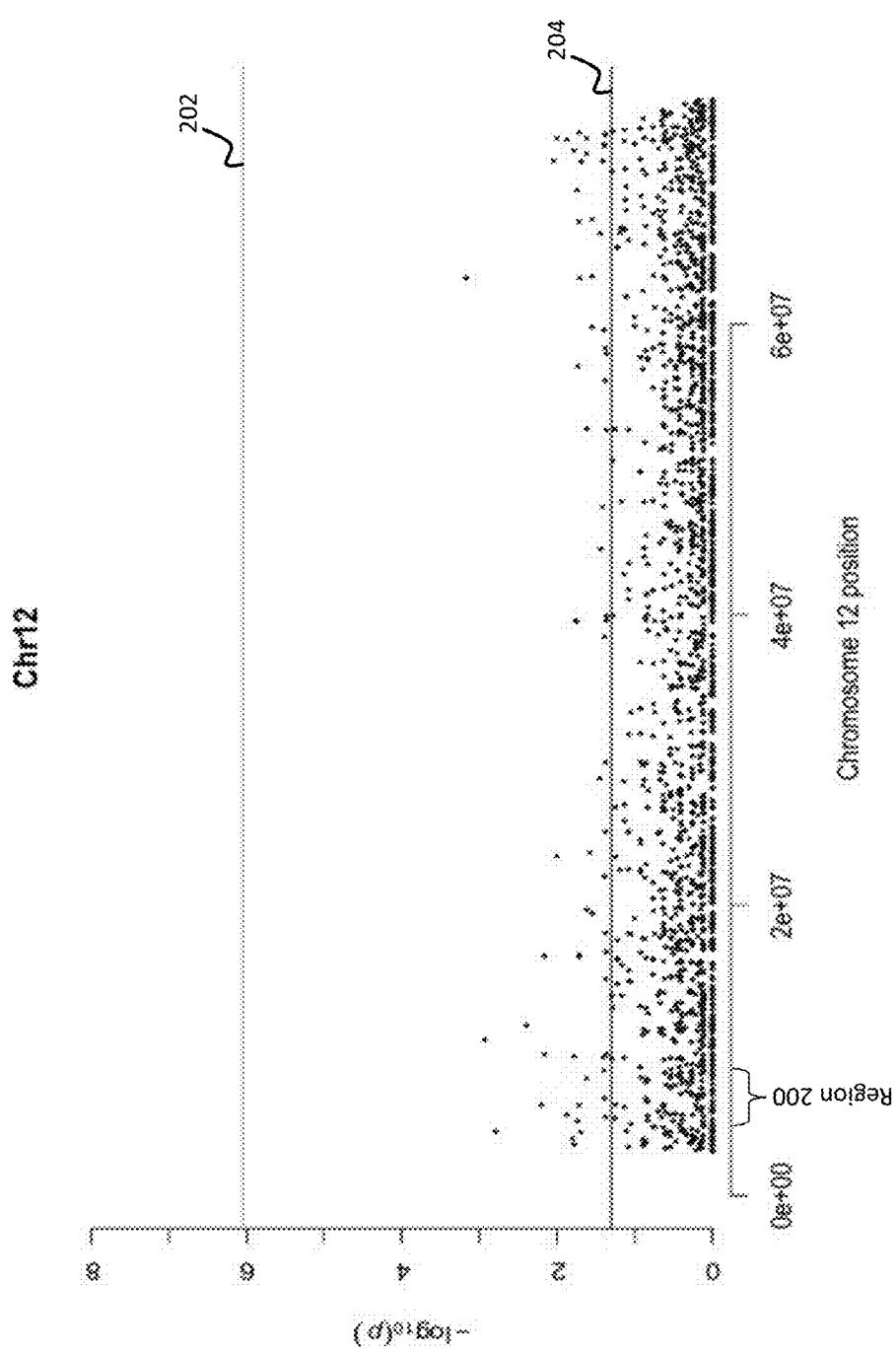
FIG. 9 is a regional Manhattan plot for the DLA II region chr12 in the Chihuahua. The associated region is labeled Region 200. The horizontal line labeled 202 represents the threshold for significant association after Bonferroni correction. The line labeled 204 represents a p=0.05 cut-off.
Figure 10:
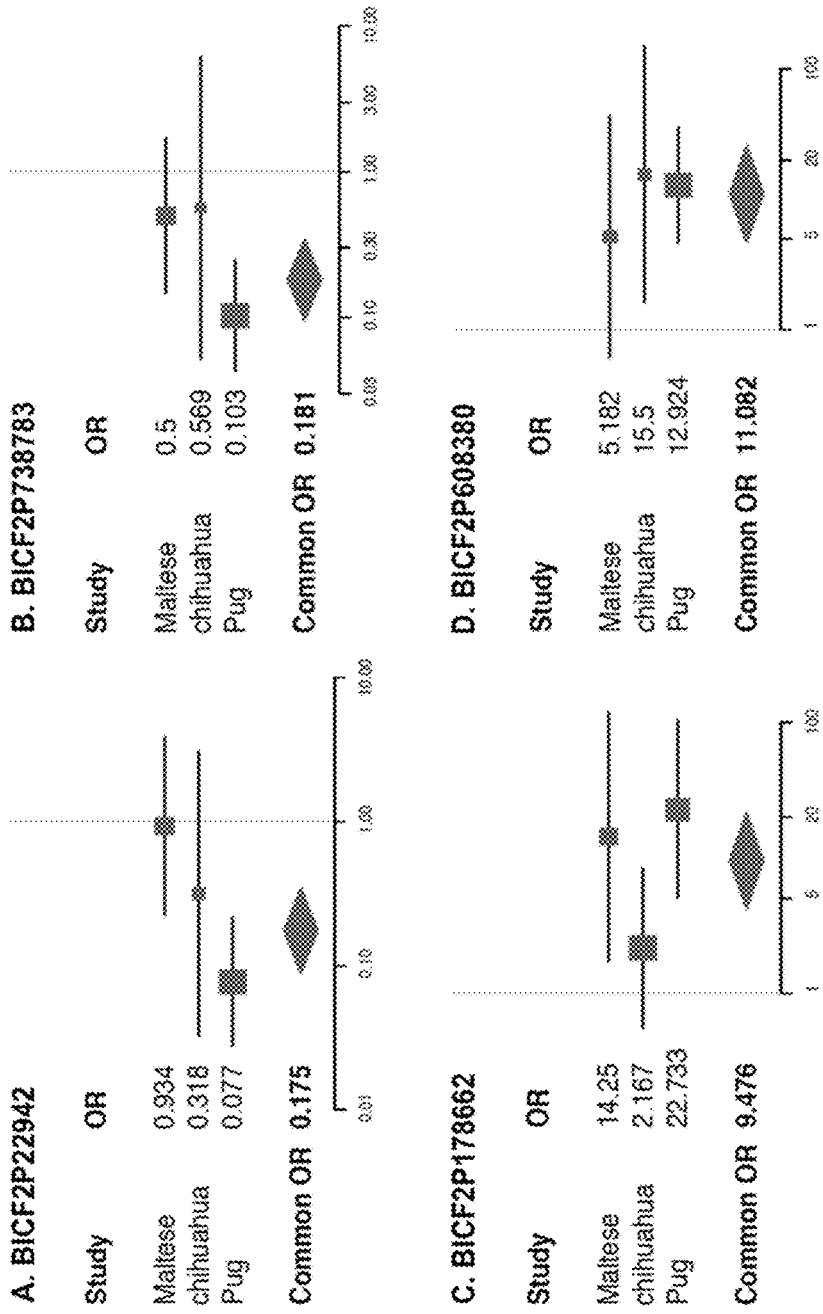
FIG. 10 is a series of Forest plots for 4 SNPs in the DLAII region across the 4 toy breeds. The 95% confidence interval for each study is given by a horizontal line, and the point estimate is given by a square, the height of which is inversely proportional to the standard error of the estimate after each study. The summary odds ratio is indicated by a diamond with horizontal limits at the confidence limits and width inversely proportional to its standard error. The meta-analyses for all these SNPs are significant and effect sizes are in the same direction. BICF2P178662: $p=1.11\times10^{-9}$ (OR=9.48 [4.19-21.40]); BICF2P738783: $p=4.11\times10^{-8}$ (OR=0.18 [0.10-0.34]); BICF2P22942: $p=1.57\times10^{-7}$ (OR=0.18 [0.09-0.35]); BICF2P608380: $p=8.6\times10^{-11}$ (OR=11.08 [4.72-26.01])
Figure 11:
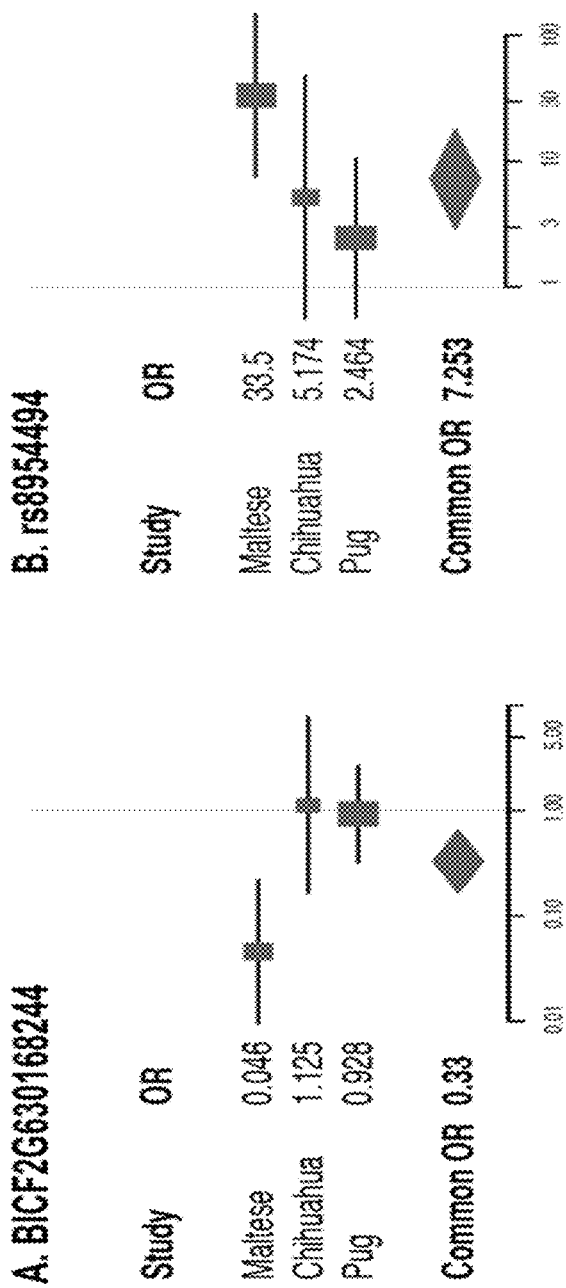
FIG. 11 is series of Forest plots for the most significant SNPs in the Maltese (CFA4 and CFA15) across the 3 toy breeds. The 95% confidence interval for each study is given by a horizontal line, and the point estimate is given by a square, the height of which is inversely proportional to the standard error of the estimate after each study. The summary odds ratio is indicated by a diamond with horizontal limits at the confidence limits and width inversely proportional to its standard error. The meta-analyses for all these SNPs are significant and effect sizes are in the same direction. TIGRP2P203665 rs8954494: $p=2.54\times10^{-7}$ (OR=7.25 [2.94-17.91]); BICF2G630168244: $p=6.59\times10^{-4}$ (OR=0.33 [0.17-0.65])

Association of the DLA II locus (chr12) with NME in the Maltese and Chihuahua was analyzed, since DLA II (or MHC II) is strongly associated with NME in the Pug and multiple sclerosis in humans (FIGS. 8-10). There is an enrichment of SNPs reaching nominal significance and similar effect sizes between breeds (FIG. 10), though effect sizes might be lessened in the Maltese and Chihuahua. A genome-wide meta-analysis indicates this region as a region reaching genome wide significance across all breeds (FIG. 10). This suggests that DLA II is a shared risk factor for NME across several canine breeds and different species with a similar disease pathogenesis (multiple sclerosis in humans).

In the foregoing description, the technology has been described with reference to specific exemplary embodiments. Various modifications and changes may be made, however, without departing from the scope of the present technology as set forth. The description and figures are to be regarded in an illustrative manner, rather than a restrictive one and all such modifications are intended to be included within the scope of the present technology. Accordingly, the scope of the technology should be determined by the generic embodiments described and their legal equivalents rather than by merely the specific examples described above. For example, the steps recited in any method or process embodiment may be executed in any appropriate order and are not limited to the explicit order presented in the specific examples. Additionally, the components and/or elements recited in any system embodiment may be combined in a variety of permutations to produce substantially the same result as the present technology and are accordingly not limited to the specific configuration recited in the specific examples.

Benefits, other advantages and solutions to problems have been described above with regard to particular embodiments. Any benefit, advantage, solution to problems or any element that may cause any particular benefit, advantage or solution to occur or to become more pronounced, however, is not to be construed as a critical, required or essential feature or component.

The terms "comprises", "comprising", or any variation thereof, are intended to reference a non-exclusive inclusion, such that a process, method, article, composition, system, or apparatus that comprises a list of elements does not include only those elements recited, but may also include other elements not expressly listed or inherent to such process, method, article, composition, system, or apparatus. Other combinations and/or modifications of the above-described structures, arrangements, applications, proportions, elements, materials or components used in the practice of the present technology, in addition to those not specifically recited, may be varied or otherwise particularly adapted to specific environments, manufacturing specifications, design parameters or other operating requirements without departing from the general principles of the same.

The present technology has been described above with reference to an exemplary embodiment. However, changes and modifications may be made to the exemplary embodiment without departing from the scope of the present technology. These and other changes or modifications are intended to be included within the scope of the present technology.

SEQUENCE LISTING (27 sequences)

SEQ ID NO: 1 - DNA, 4121701 bp, Canine spp. (residues 1-2,060,851 of 4,121,701)
  misc_feature (47680)..(47775): n is a, c, g, or t
  misc_feature (51930)..(54842): n is a, c, g, or t
  misc_feature (69336)..(69631): n is a, c, g, or t
  misc_feature (77302)..(77881): n is a, c, g, or t
  misc_feature (372046)..(372208): n is a, c, g, or t
  misc_feature (415822)..(416054): n is a, c, g, or t
  misc_feature (447511)..(447647): n is a, c, g, or t
  misc_feature (597085)..(597159): n is a, c, g, or t
  misc_feature (932668)..(932722): n is a, c, g, or t
  misc_feature (1112563)..(1112670): n is a, c, g, or t
  misc_feature (1121582)..(1121791): n is a, c, g, or t
  misc_feature (1125670)..(1125886): n is a, c, g, or t
  misc_feature (1128841)..(1130039): n is a, c, g, or t
  misc_feature (1133950)..(1134022): n is a, c, g, or t
  misc_feature (1142791)..(1143414): n is a, c, g, or t
  misc_feature (1302167)..(1302167): n is a, c, g, or t
  misc_feature (1485108)..(1485411): n is a, c, g, or t
  misc_feature (1511373)..(1513902): n is a, c, g, or t
  misc_feature (1525812)..(1527173): n is a, c, g, or t
  misc_feature (1551312)..(1551355): n is a, c, g, or t
  misc_feature (1557346)..(1558099): n is a, c, g, or t
  misc_feature (1661044)..(1661297): n is a, c, g, or t
  misc_feature (1664024)..(1664587): n is a, c, g, or t
  misc_feature (1665318)..(1665425): n is a, c, g, or t
  misc_feature (1673704)..(1673837): n is a, c, g, or t
  misc_feature (1742657)..(1742657): n is a, c, g, or t
  misc_feature (1818640)..(1818997): n is a, c, g, or t
  misc_feature (1820864)..(1822549): n is a, c, g, or t
  misc_feature (1823227)..(1823834): n is a, c, g, or t
  misc_feature (1826090)..(1826090): n is a, c, g, or t
  misc_feature (1841658)..(1841792): n is a, c, g, or t
  misc_feature (1864584)..(1864584): n is a, c, g, or t
  misc_feature (2039695)..(2040344): n is a, c, g, or t
  misc_feature (2053185)..(2053396): n is a, c, g, or t
  misc_feature (2055020)..(2055044): n is a, c, g, or t
  misc_feature (2245964)..(2246041): n is a, c, g, or t
  misc_feature (2313152)..(2313586): n is a, c, g, or t
  misc_feature (2595493)..(2595660): n is a, c, g, or t
  misc_feature (2603699)..(2605049): n is a, c, g, or t
  misc_feature (2673369)..(2673427): n is a, c, g, or t
  misc_feature (2683838)..(2683838): n is a, c, g, or t
  misc_feature (2762679)..(2762696): n is a, c, g, or t
  misc_feature (2768337)..(2768716): n is a, c, g, or t
  misc_feature (2781178)..(2781404): n is a, c, g, or t
  misc_feature (2809171)..(2809188): n is a, c, g, or t
  misc_feature (2866169)..(2866288): n is a, c, g, or t
  misc_feature (2872438)..(2872632): n is a, c, g, or t
  misc_feature (2874651)..(2875352): n is a, c, g, or t
  misc_feature (2919729)..(2919729): n is a, c, g, or t
  misc_feature (2973352)..(2973391): n is a, c, g, or t
  misc_feature (3065733)..(3065783): n is a, c, g, or t
  misc_feature (3121383)..(3121484): n is a, c, g, or t
  misc_feature (3150472)..(3150472): n is a, c, g, or t
  misc_feature (3153643)..(3153849): n is a, c, g, or t
  misc_feature (3159627)..(3160516): n is a, c, g, or t
  misc_feature (3168272)..(3168487): n is a, c, g, or t
  misc_feature (3267063)..(3267072): n is a, c, g, or t
  misc_feature (3367561)..(3367671): n is a, c, g, or t
  misc_feature (3437432)..(3437847): n is a, c, g, or t
  misc_feature (3439000)..(3439498): n is a, c, g, or t
  misc_feature (3447319)..(3447617): n is a, c, g, or t
  misc_feature (3527217)..(3527268): n is a, c, g, or t
  misc_feature (3598312)..(3599438): n is a, c, g, or t
  misc_feature (3639070)..(3639602): n is a, c, g, or t
  misc_feature (3759074)..(3759360): n is a, c, g, or t
  misc_feature (3908098)..(3908320): n is a, c, g, or t
  misc_feature (3915608)..(3915608): n is a, c, g, or t
  misc_feature (3917868)..(3917868): n is a, c, g, or t
  misc_feature (4015567)..(4015759): n is a, c, g, or t
  misc_feature (4024564)..(4025110): n is a, c, g, or t
  misc_feature (4077020)..(4077113): n is a, c, g, or t
  misc_feature (4084691)..(4085160): n is a, c, g, or t
ttcactcctgtcccaggggaaccagggtagagctgtggttctctgagtgtggcccttggaatattagtatcaggatcccatctacctccttagacatgcacatagttggacccaccccagacatactgagccagaatctctggaggtggagcttagcagtctgtgattcttaagcctcccagatggttgtggtgcctgtgaatgttacaactactgagttagagagtccttcatggaagggcttggagccaggagcacaggctactgacagtctttttgatatcattactgggtctcaaagttgtggtaagaggaaattgaccccattcagagtagtcacagctgagtccctcaggtcagcgccccccacttgacacttgctcacctgcttgcgtctgctacctgccagtgtgagttccctgcatctctctagctttttcactcctgtgtctgtgtccacagaggagttcatggtgattggcccctcaaaacccattgtggcagtgctgggtgggaacatcacattgctgtgtcatgtgtccctacccatggagaacatggagctacggtggtttcattctaggttttcagaagtggtgttcatatatcaaaaccagcgagagcagcaagagggacagttggcgcaatacacagggcggacgtcgctggtaaaggacttcctcccctggggggaggctgctgtgagcatccacaaggtccaggctttcaacaatggtctatatacctgcttcttcagaaagggaagcatctatgaatctgccagttttgaactgatggtggcaggtgagtggttgacctctatctagagtcctatagtattggagttgggagcaacctcaggggctcagtaaaccagcccctccttttaaatatgagggaaagaagtgtcattctcatttatccatttattcaacatgaatatatagaattcctaataagtgccagatccccttcaaggcacctagctacatcagtgaaccaaacaaagacccctttcctgcagtttatattctagaggaaataatagatgtacagatgattatagaagatgttagatggtagtgggtagagacttaaccaagtcgatatctgaggatggatgagagttccaagcagaggaacaccaatgtgaaacaactgagatgggagtgtgtccagtgtgtctgggcacacaaggaggccacatggttggtgagacaagtggatgggagggtagtgagaggtgagaatcctggaattaagaggtgttgctggcccatgggcacagaaacagggttgatttggaaaagttcatgaggagtatgtacttgagcaggtacttgagtgaaccagacagtgctctaaagatcccctctggttcatggactggatcatgaggagtatgatgactgtggttatgaccagttaaccaaatagtcctgggctggaatatgtgtgtctttaggggggaaggtgagggaagttgggaaggaagtggacagggattttgtgggtggcagtgatgccagattataaaaggctttgtgtgctgtggtatagagtttggatgcagagatgagagaattttaaacagaacagtagagggaagggtgtgtctattggaaagtttgctttgagagctctaagtatgtgtatatggaagatgagtaagactggaggcctggatatagttatggcatggagaggagggctgcctgtattcatataggggcagtagggtgagaaaggtgggatctggcattagggaggtttaaaaagtagacccaactgagtgagtaattttagagacagagtttgggagtgggcaaagaagggattgcaaagtttcccaaggtgttttttgtttttcttccttttctttctttccttccttccttccttccttccttccttccttccttccttccttccttccttccttccttccttccttccttccttccttccttccttccttcctttttctttctttctttctttctttctttctttctttctttctttctttctttctttctttctttctttctttctttcgattgttgtttaataatagaaatactaatacagttgccatttgctgcaatagtgttgttgtaacatagacctagaaatcttactggcatatagcaacaaccattcatttaatttgggcattaagggagttcagctcatctgtactgtatttagctaatcttaactgggcttacgtatacatatttggtgatgtaggggaaacataattaaaaagaaatctcctatggggcgcctggttggctcagttatttaagcatctgactcttgattttggctcaggtcaagatctcagtgtcctgggatctagacccacatagggctctgcactcaggtggaatctgcttgaggatttcctccatctgcccctcctttgctctctttctcttccagaggaataaataaataaataaataaataaataaataaataaataaataaaaatatataatataatatataataatatatataatatatataatatatataatatatatatttattattttataggagttcaatttgccaacatatagcataacacccagtgctcatcccgccaagtgccccctcagtgcctgccacccagtcaccccaacccctgcccacatccctttccactaccccttgttcatttcccagagttaggtgtctctcatgttttgtcaccctcactgatattttcactcattttctctcctttcccctttattccttttcactaatttttatattccccaaatgaatgagaccatataatgtttgtccttccctgattaacttatttcactcagcataataccctccagttccatccatgtcgaagcaaatggtgagtatttgtcgtttctaatggctgagtaatattccattgtatacatagaccacatcttcgtaaatacatctttaaaaaacaaaatctcacaatgctgaaatcttcacaaagataatagggaaagaaaatattaaaaaagaaaatgtttaaaaatatttttaacattgaattatcattaattagaatgtgatgagcatcacagagatgcaaagagatacaaagacagaacagatcttatccttttatgcagctatgcagatagaactcattatatacatgtcctgaggataaacaattactaatttttgagtaagtggacatgatagcaccatttgacacagacaatacactctaaatttacttggtagctggggtgatcatctatgatagctagttggctttatctggaacccccccccccccaattatcctatgtttatgacaagaagtggttttataatttggatcctggtgactagtggtgttaggcacctaccctggcacaggaagtgggagagaggagtgctgtcttccttggtgttaatggtttaaagagaggcctttcaggtccttaagacatatttctggatcataatgctggcaaaaagcctatctagttttcacaaaggattttatttttattttttaatttttattattcatgagagacaccgagagaggcaaagacataggcagaacctgctccatgggctttcctcatctgggccactacttcccatccagtgctagggaacatggggtgatggtggtccttggagtcattcataaaccttgggtttattccagtgcttatctatctgctgcattcccagctgtttagctttcagtgcaatttgttctcagtcagaatctggaaaccaaaagtcagctgctgtgagattttgtttaagaaactgtataaataggggtacctggatggctcagttggttaagtggctaactcttgattttggctcaggttatgatctcagggtcctgggattgagccccatgtttggctcctcacccagcaaggagtctgcttcaggattttctctctccctcttctgacccctctccccacactctctttctctcaaataaataaatattttaaaaaggaagctatataaataaatgggggcattaagtttagaagtgtgacccctcaagtaatcaatgcagtgagagtctgttctctttagttcttagaggagctgatcacaaagtaatggttagaggactgggcagaccatgtgttgaagtatggtggtgtgagctgtcagtgctccagaatagctatgtgttttctgagaacgtttgaccacttttaccccagaggtcaccttacctcctgtcatgaaatcacttccctttttgggttatttcccaaatacctctttgcttgataagactgggtgtaataatgatttcttaacattttggagtaatttatattttattccataaaatattttttgtcattgcatacttttttattcatcacaaataaatttgatgcagctagacaaaacattttgaggtttttaaaaaaatttttcactggagtccaatttgccaacatgtagcataacacccagtgctcatcctgccaagtgcccccctcagtgcccatcacccagtcacctcaaccccctgcccacctccctttcaactaccccttgttcgtttcccagagttaggtgtctctcatgttttgtcaccctcactgatattttcactcattttctctccttttccctttattccctttcactaatttttatattccccaaatgaatgagaacatataatgtttgtccttctccgattgacttatttcattcagcataataccctccagttccatccatgttgaagtaaatggtgagtatgtgtcgtttctcccatccaagtactaaccaggcccgaccctgcttagcttccgagatcagacgagatcgggcgcgttcagggtggtatggccgtagacgtatgtgtcgtttctaatggctgagcaatattccattgtatacatagaccacagcttctttatccattcatctttcgacggacaccgaggctccttccacagtttggctattgtggacattgctgctataaacattggggtgcaggtgtcctgctgtttcactggatctgtatctttggggtaaatccccagcagtgcaattgctgggtcataaggcagttctatttttaactctttgaggaacctccacaccgttttccagagtggctgcaccagttcacattcccaccaacagtgcaagagggtttccctttctccacatcctctccaacatttgttgtttcctgtcttgttaattttccccattctcactggtgtgaggtggtatctcattgtgattttgatttgtatttccctgatggcatgtgatgcagagcattttctcatgtgcttgttggccatgtgtatgtcttctttggtgagatttctgttcatgtctttgcccatttcatgattggattgtttctttgctgttaagtttaataagttttttatagatcttggatactagccctttatctgatgtcatttgcaaatatcttccccattctgtaagttgtcttttagtttttttgactgtttcttttgctgtgcagaagctttttatcctgattcagtcccaataattcatttttgcttttgtttcccttgccttcatacattgtatcttgcaagaagtttctgtggccaaattctcctctaggatattgatggaatcttgtctcacatttagatctttcatccattttgagtttgtgtatggtgtaagagaatggtccagtttcattcttctgcacatggctgtccaattttcccagcaccatttattgaagagactgtcctttttctagtggatagtctttcctgctttgtcgaataatagttgaccatagagttgagggcccatttctggattctctattctgttccattgatctatgtgtctgtttttgtgccagcaccacaccatcttgatgatcacagctttgtagtacagcttgaaatccagcattgtgatgcccccagctatggttttctttttcaatattcccctggctgtttggggtcttttctgattccacacaaaccttaagatgattagttccaactctctgaagaaagtccatggtattttgatagggattgcattaaatttgtaaattgccctgggtagcattgacattttcactgtattaattcttccaatgcatgagcatggaatatttttccatctctttgtgtcttcctcaatttctttcagaagtgttctgtagtttttagagtatagatcctttccctcatgttggcaaattgaactctgataaaaaaatcctttccctctttggttaggtttattcctaggtatcttatgcttttgggtgcaatgataaatgggattgactccttaatttctctttcttcagtttcattgttagtgtgtcgaaaaaccattgatttctgggcattgattttgtatcctgccacactgtcttttttttttttttattggtgttcaatttactaacatacagaataacccccagtgcccgtcacccattcactcccaccccccgccctcctccccttccaacacccctagttcgtttcccagagttagcagtctttacgttctgtctccctttctgatatttcccacacatttcttcccccttcccttatattccctttcactattatttatattccccaaatgaatgagaacatataatgtttgtccttctccgactggcttacttcactcagcataataccctccagttccatccacgttgaagcaaatggtgggtatttgtcatttctaatagctgagtaatattccattgtatacataaaccacatcttctttatccattcatctttcgttggacaccgaggttccttccacagtttggctatcgtggccattgctgctataaacatcggggtgcaggtgtcccggcgtttcactgcatctgtatctttggggtaaatccccaacagtgcaattgctgggtcgtagggcaggtatatttttaactgtttgaggaacctccacacagttttccagagtggctgcaccagttcacattcccaccaacagtgtatgagggttcccttttctccacatcctctccaacatttgttgtttcctgccttgttaattttccccattctcactggtgtgaggtggtatctcattgtggttttgatttgtatttccctgatggcaagtgatgcagagcattttctcatgtgcatgttggccatgtctatgtcttcctcagtgagatttctgttcatgtcgtttgcccatttcatgattgggttgtttgtttctttggtgttgagtttaagaagttctttatagatcttggaaactagccctttatctgatatgtcatttgcaaatatcctctcccattctgtaggttgtctttgagttttgttgactgtaacctttgctgtgcaaaagcttcttatcttgatgaagtcccaatagttcatttttgcttttgtttcttttgccttcgtggatgtatcttgcaagaagttactatggctgccacactgtctaattgctgtatgagttctagtaatcttggggtggagtcttttgggttttctaagtatagtaaatgatgagcatcttaatttaaaaatactctattgctgaaaaatgctaagcatcatctaagctttcaatgagtcacagtctgtttgctggtggaggatcttgcctcagtattgatggcagccgactgatcagggtggtggttgctgaaggttggaatgactgtgacaatttcttaaaataagacaatgataaagttggctgtatcaatttactcttcctttcttgaatgatttctctgtagcatgtgatgctgtgttcaatagcattttactcatagtagaatttctttcagaactggagtcaattatctcaaaccctgttgctgctttatcaactaagtttatgtaatattctgaatcccttgtcatttcaacaacctttatagtatcttcaccaggagtagattccatctcaagaaatcactttctttgcttttccatcagaagcaacccctcatccattaaagtttgatcatgagattgcagccatttagtcacatcttcaggctccccttctgattcttgttctcttgctatttccaccacatctgcagctacttcagccaaagaactcttgaactcttcaaagtcatccatgagagttggcatcaatttgttccaaactcttgttaatgttggtattttgacctcttctcatgaatcataaatgtttttaatggcatctataaaggtgaatcctttccagaaggttttcaatttactcgcccagatctatccaaaggattactatctgtggcagctatagctttaattaattaagttgattaattagaaaaaataatttgagtgtagttaacatacagcattatattagtttcaggtgtacaatatagtgattcaacagttccatatattactcagtgctcatcaagataagtgtactcttaattctcttcacctatttcactcatcctgtcatcctcaacatgtttgtttgtttgttttccataaatagcatggatcccagctcaggatactgagatcaggacctgagctgaaatcaagagtgagaggcttgaccaagtaaaccacacaggcaccctgaaatgtacttaataaataatgagacttgaaagttgatactactcctttatccatgggctgcagaatggatattgtattgacagtcatgaaaaccacattaatctcattgtacatctacataagacctcttgaatgacaaggtacattgtcaatgagcagttatattttgaaagtaatctcttttctgagcagtaggtctcaacaatgggcttaagatattcagcaaaccatgttgtaaacagatgtgctgctatttaggctttgctgatccatctatacaaaacaggaaaaatagatttagtgtaattctggagggtgctctgaaatggcttttgaaatggtaaaggaacattagctttgacttagtctagctgctttctcccctaacaaaagactcagcttgtcttttgaagctttggattcaggcactgacttctcctttcttattatgaaagtcgtagatggcattttctccccaatataaggcatttttgtctacaatgaaaacttatttagtgtagccattttcattacttagctagatcttctggataagttgctacagcttctacatcaacacttgctgcttcaccttgcacttttatgtttgtagagatggcttctttgcttaaacctcatgaaccaaactctggcagcttcaaaatttcttctgtagcttctttacctctctcatccattgtagtagaactgaagagagttagggcctaattctgggttaggctctggcttaagggaaggctgtggctagtttgatattctatccagactactaaaactttctccatgtcagcaataaggctgctttgctttcttattatttatatgtttgctggaaaggcacttttaatttccttcaagaacttttcctttgcattcacatcatggctaaatatttggtgccagaggactagctttcagccttacttagctttcttttattattattaatattattaatattatttttttattggagttcaatttgccaatatatagcataacacccagtgctcatctcatcaagtgcccccctcagtgcttgtcacccagtcacccccacccacctgcccacctccctttctaccaccctttattcgtttcccagtgttaggagtctctcatgttctgtccccatgatatttcccactcattttctctcctttcccctttattccctctcactattttttatattccccaaatgaatgagaccatataatgtttgtccttctccgatggacttctttcactcagcgtaataccctctagttccatccacgttgaagcaaatggtgggtatttgtcatttctaatggctgagtaatattccatcgtatacatagaccacatcttctttatccattcatcttttgatggacaccggggctccttccacagtttggctttgtggacattgctgctataaacattcgggtgcaggtgtcccggcgtttcattgcatctgtatctttggggtaaatccccagcagtgcaattgctgggtggtagggcaggtctatttttaactctttgaggaacctccacacagttttccagagtggctgcaccagttcacattcttagctttcaacatgtcttccccactaagcttaatcatttctagcttctgatttaaagagagacatgtgactcttcctttcacttgagcactgagaactgtcacagggttatttactggcttaatttcaatactgttgtgtctcagagaatagggagacagtcagtcagacagacagacagcacatctgaacactgcacagcacttgtcagttaagttcatcatcttatatggctggggttcatggtgcccccaaacaattacaacagtaacatcaaagatcactggtcacagaccaccgtaacaaatataacaataatgaaaagtatgaagttttttgaaaattaccaaaatgtgacatggagacaggaagtgagcaaatattggaaaaatggcaccaatagacttgcttgatttagggtttccacaaaccatcagtttgttaaaaaaagggggagggaagagaaagaaaaagaaaaaggaaaaggcagcatctgtgaaatgtgataaagtgaagtgcaataatataaggtttgcctgtattaagaatgaactatttcttagtcactgccatctcctttgctgtcaatttgctcctattcactatccatcatgctcctaaaatgtctcctccatggacttaactgcaactgttttattcctctgtcaagtttttgttctcttttttcttacatgctatttctcagtttctttgcttgttctccttccttttttttttaaaactaagtttcaacaaagcacaactatgtaggcttatagtctgtcttttggagatctgatctaattctcattatttgaatatctcctacaagaaatgaccctttaacctgtaccctgttcgtatccataattacatctctcctcaatctaaacaattttttatttttctccttgtggatttcccttctatgattgatgtttttatgttatcagttaccatgcatcaaattggagtcatcttgaatttctccatgtcacatacattcagtttgttgttcaagtcagttcatttctcttttgaaatgattctcacatgtgtttctttcattttattctcattgcctccaaattagttaggctgttgccttattttctggctgtatcattacagtcatcttctagttgatctcttagtcttctttctgttgtctaacccaccagtttacactttctgaaagacaactcaggttatatctgttgcctatgaaataagtggaataaaaatccacttaaaagtttaagctaataaataaaataaaagcttaagtccctcagaactctggtttcttattccaaccttattttcttctaataccctcagcatttgccaatttcaatcatttaggtttcaccatttgtcatgatttttagtatatctaaatagaattacactattttttactttttaaattgactcaccatacttaatctcatcttactctataatttcaaaaatcatgggcttgatatactttaaaaaatttacataaaagtaaacattaaatattactataacaatgtttatttggggaccacctgaaatcatcttctacatcagtggggtcctcattcccttttgtgtccttatccttgaggagctttgctgtactcaaattctctgctctcctctctgcctttacaatagtctttccatgttctaaactttttttcttctcacttcctttcccagtcaattaaatttaataaaccttgtggtaggcaccgaggatggagatcatggtaagacacagatcttccttcaaggggtttatcctctggtatagagggattactaatccaggggccccaaacaatatacaaatccttcccatcgtcttttgatgcccagttcaagttctactgcctgtgaaagtctttaatgtattatccctaaacaaagagattttccttttcttattttttcctgttgtatttttgctctgaattttttgatatttatatttttaacatggttttactgttttcatttctgtttatattattgataaagatattttgcatacctttacagatgttgcacctagtagagactaagtatatagctatttggttagataggaaaacaccatattttttgagaaaatacagttctacatttctttaatcagagtttaatttttatttgtgttttcctgactgatacctcgtgagtgtgtattctgaaaaactcatatttagaagctgaagtttgagactgagggatctacaaagaagcattttatgaagcttttgccagattataaacaaagaagcagaaaatttgtgactaaaaagaatggagtatattatcttaatctcaatcacagaagatggagagctagttttgaagtctatgtgctagagcaaaattattcaattctgttttgttagtttatgaaatctagtgttattttttcttccatgagatctttcttttactgctcattttctttccttcgcctacttttgggtctatattcttgttctctttagccaccttgtttttatacttttttttcatagaatttcctttcatattcttgtcctttctcttgccttcaccttcattcttgcccaggtcctttgtcccgttctcctctcccttatagtccttgtcctcatccttctttatatagtcctctccattcttgtccatgtcctctgtcctgtcctcctcctcctcctcctttatatactcatgtcccttcttgtccatgtcctctgtcccatcctcatatcccttatagtccttgtcctcctccttctttatatactcatctccctttgtatctatgtcttctgttctgtcctcatatcccgtatagttcttgtcctcctcctcctttatatactcatctccttccttgtccatgtcctctgtcctgtcctcatcttccttattgtccttgtcttcatcctcctttatatactcatctccctttgtatctatgtcttctgttctgtcctcatatcccgtatagttcttgtcctcctcctcctttatatactcatctccctccttgtccatgtcctctgtcctgtccgcatctctcttatagtccttgtcctcctcctcttttatatactcatctcccttcttgtccatgtcctctgtcctgtcctcatatccctttatgtccttgttttcatcctcctttatatatttatctctcttcttgtccatgtcctctgtcctgtccttatctccctttgtgtccatgccttctatcttatcctcatgtcctttcttgaccttatccttctttttgttcatttcctcccccttgtatttattcttctttaagcctttgccttccttcttgtctttatctgcttttgtgtctttgtcctccatgtcctcatctcccttctttttcatgttcaccttttcttcttcttcacctttatcttttacgtcacttcctttctttgattggcccttatctatttcctttcctttatccatgtcctcggtatcttttcttttgtcttctatttctcttctctcttctttactctgagttttctcaggaagcttttcaattttcactccagttttctgtttttgtctcttttcataggtctcagggccacttatttctcccttatgctggtatttaggaccactttggatagtttgggatggaactatctgaattctcaaacgaatatcatgttttggggttttccttgcttctttagtgtttctttttacttctgtttttgcattttctttcaaattacctgaaaatataacagatgatataataaaagtgcatacataattcatatcttagggctttttttattgtcaagttttgttatataacacttatactttgctctaaatttgaaacaatcgatttgttttctcaataatacaaaatttgtgaaactgtacacatatgaaggattagataagaagttcttgaaatacagactctccaggaattgaactaagaaaagggaaaaatacaacacaaaggaattagtaattcctcagtagaatatggctagagtgtatgattaaaataaagatgtagtatgaaaaggataaccttctctgagaaaattacattattatatgatatttatgattccttaaggaaatttcatctccttttgagtaataaagagaattgctaagccagcagtttgagagacaatgaggctggaattttccttaactatctttttttttttttttccttaactatcttataggttttcaagaagtgtgttttaaaagtgatttggagatggtagcaatacttaaggtagtaaaatagcttttttttttagtaactttgctaataataggaatatttattgttgtgtgatacatggaaaactaaaattaatgttttcataaataggaaaaatagagcatgattatttgttttattgaaattcagtttcctttagttaatcttttcatgattaatttctcttttaattgatcttgagtgcttgctaagtgtcaataaccctttccttacttaatctagcgccaataaaacaagtagttaccaaaatatgagaggaaacattttaagcaagtaatgagttaggagtctccccaaattgggagtgggtcaaaagtttatgagagctcatagttgtgcatcatagtggcctccctttataagactcccagatatttggcactggacattcagatttattcagttggtacgtataccagtacacgtgctctctaattggctcttctctttggctggagtcaaggtgaatgtggcatgagctgtattggacaacaacccccatccacatttcttcttctctgtgttttattagtgaaggaaaattaatgctggaacatacagcaacttgaaagttatgagagcaagcatgaagtaattcataattatgaaactggacagatgatgttgagggtagagagatgggggaggatatcataaagaccattttcaatagagcttccaacctggaatgtaggcattgtggaataggtctgttcttattttgagaaagcttgttagactgaattcaggatagtgaagagatcattggatgaggaatttaaaaatatttgagttctgtcactatgtggcctttgccaaagactcttaatctttttgtatcttaactttttcatatgtacaatgaagttaataatagtggccttgtttacctcatagagttatgtggggacaaaatgagaaaaagtatatcagacactttaaaaattgctgaaataatagacacaaatacatttgaggttaacaacttacaacacaagaggaaattttaatatcaaacataattagtacagtggtcttttaatttaaaagcaattcatggttctgtgcacatacgattgattggaataaaaagtttgcaaaatattctatttatgtaatcttgtaattaaaaaaaatattattattattattttttaatcttgtaatttttaagccaatctcctattggtgcaaattttaattattgtgaataatgatgtgataaaccacttaatacatatgccttaaaaagttccctttttttccttaggaaacatttctaaaagtataatttcttagtaaaggatgtgcacatcttgtattctgaaacatattgtcaaatgcactcttgaaaagttaaaccaagttgccttagtactaatagggcatagaaatagaaatatggccaacacccaaaaaacatactctgcatatttttacaatttttcataaatatatagctttaaaaaaagctcttcttcattttcctttgattaactagtatttttggatttttagcatttattgataatattacctgtatcttttgctttattttttcccccagagatcattgtatattgaggctataaagtttttatgctgtataaattttgttttcttaatttctatttacttttcagacttgttcatagtggtcatttttacatagaagttaaaaaaatgtagtctaattaatcagacttaaattatagtttctgtattttacatcattcttagaaaataattttgtttgttgagagtactataagattttagtttacaaagtaaaaaatatttcataacacacgagttacctactaatcattttttaattaaaaatagaaatataatatgatccagtaattctactactgggtatttactcatagaaaatgaagaaactaatttgaaaagatatacaccccccatatttactgaaacattatttataatagtcaaaatgtggaagcagcccaagtgcaatcaataggtgaatggataaagacggtatggtatatacatatatatgcaatgaaatattactcgccatgaaatcttgccatttgcaacacagatggatccagaggggattatgctcagtcacataagtcagacagagagagacaaataccgtatggtttcatttatatgtgaaatccagaaaataaaacaaataaacataaaaacccacacttctaaatacagagaacaaactggtgatttgtcaaaggggaggtgaatgagggagtgggtgagtgcgatgaaaagtaaagcatagggaatataaataatattgtaagaatgttgtttggtgacagatatggtgactacacttaccacggtgagcattgagttgttgagaatcactatgttgtacacctgaaaataatatcacattatatgtcagttatgcttcaataaaaaagtcaagtcttgatatgagacagctttataatgtagacattaatattgaaaacttttcaaacttccaaatttagacttgtgcatttttatagaaatcaggctagtgtcaaaaaaagagaataaaatctgaagtcaaaagaactggtttaaataaattggtttatcatttaacagttaagcaacataggaaatgagccactgatctattaaatatattaaagaaattacctacctagccataaattgttattttctggcacataatatatcttcagtaaatatttgtttaaaatttaaaaggatatttcatggttgaaaaatattaattatgagaagttttgaaaaacaaagaggttcaaggacaaaaaatatcactcacagtcccacaactcaaggattaccacccttgattcattttattctagatctagatgcttagattgtattttaaatcaatcaattgggatggcctgggtggctcagaggttgagctgagcgtttgccttcacctcaggacatgatccgggagtcctgggattgagtcccgcatggggctctctgcacggagcctgcttctctgttccttatgtctctgcttctgtgtctctcatgaataaataaataaaatcttttaaaaaaatcaatctttttttctttctttctttctttctttctttctttctttctttctttctttcaatattgtgaaaatgtcaatgttacccagggcaatatacacgtttaatgccatccctatcaaaataccatggagtttcttcagagagttagaacaaattattttaagatttgtgtggaatcagaaaagaccccgaatagccaggggaattttaaaaaagaaaaccatatctgggggcatcagaatgccagatttcaggttgtactacaaagctgtggtcatcaagacagtgtggtactggcacaaaaacagacacatagatcagtggaacagaatagagaatccagaagtggaccctgaactctatgggcaactaatattcgataaaggaggaaagactatccattggaagaaagacagtctcttcaataaatggtgctgggaaaattggacatccacatgcagaagaatgaaactagaccactctctttcaccatacacaaagataaactcaaaatggatgaaagatctaaatgtgagacaagattccatcaaaatcctagagaagaacacaggcaacaccctttttgaactcggccacagtaacttcttgcaagatacatccacgaaggcaaaagaaacaaaagcaaaaatgaactattgggacttcatcaagataagaagcttttgcacagcaaaggatacagtcaacaaaactcaaagacaacctacagaatgggagaagatatttgcaaatgacatatcagataaagggctagtttccaagatctataaagaacttattaaactcaacaccaaagaaacaaacaatccaatcatgaaatgggcaaaagacatgaaaagaaatctcacagaggaagacatagacatggccaacatgcatatgagaaaatgctctgcatcacttgccatcagggaaatacaaatcaaaaccacaatgagataccacctcacaccagtgagaatggggaaaattaacaaggcaggaaaccacaaatgttggagaggatgcggagaaaagggaaccctcttacactgttggtgggaatgtgaactggtgcagccactctggaaaactgtgtggagattcctcaaacagtctttctttccctttctttctttctttctttctttctttctttctttctttctttctttctctctctctctctctctctctttcgttctttctttctttcttttcttcttttctttcttctttccatagttgtggcctaagtataattgcattctaaacaatttaatgctacgtttcattctattaaaagcctttttccatattattgcaaattgtatgtaaacagttttaaatgtgctatgattttttttacattgtaaatacaccatagtatttcagatttatattatttgtgagagggaaagagtacatacttgcatggaacagcacattgtaatgaatgtggaagatttagtaactgttatttatctagaaatatttgcagtgtctttgcaaggtcaagttatatatataatctaaggaaaaatataaaactgatattggtattaaattgagtatttggtattaaattggtattaaacggagttatctgaagaaggcatttaagtgaggcaatccctgtcccaggcatctgccctgatttagaggcatttggtagcttttatttatttagggctataacggcaaatcttaatgatagcaaatttcattataattatgaattattttcaataacttcattttttcggtattttttttattggagttcgatttgccaacatatagtagaacacccagtgctcatcccgtcaagtgcccccctcaatgcccatcacccagtcaccgcatcaccccgctcacctccccttccactaccccttgttcatttcccagagttaggtgtctctcatgttctctcaccctcactgatatttctcactcgttttctctcctttcccctttattccctttcactattttttatattccccaaatgaatgagaccataatatgattgtccttctatgatattttcaataacttcataaagaaatgactgccctagttgaaaacttattttcaaaaacatttggcatatactaatcctgcagctcactggagttcattttaaatgtactgttgagaagggaatataggggaagggagaagaaatgtgtgggaaatatcagaaagggagacagaacataaagactcctaactctgggaaacgaactgggggtggtggaaggggaggagggcgggtgtgggggtgagtgggtgacaggcactgagggggacacttgacgggatgagcactgggtgttattctgtatgttggtaaattgaacaccaataaaaattattttattaaaaaatgtactgttgaactggatttgccaatattttgtttataatgtttatatctatactcattaggaatattggtctatagttttcttctagtgcccttagctggctttggtatcagaggaatgtcagccttgtaaaatgagtttggaagtgttttcctctattcaatttttaggaggagtttgagaagtgttgacattaattattctttaaatatttcatagaattcaccattgaaatcatctagtgccgggattttctctattaagagttttttcccctttactgcttcagctagtcagttgtatgtctataagaatgtatttatttattgtaggttatccaaactgttgcatataattgttcataaaagtctcttagaatcttttgtatttctgcaggatcacttgtaatgtcccttctgtcatttctgattttgcatcttcttttgtttttaattgagctgcagattggttaattttgtatatctttttgaaaaaccacctttagctttgttgatttttctatttttttttctggtttctatttcatttatttatcctctgatctttgttatttccttccttctgccaactttggcttagtttttttttttaccccctagcatcttgaagtgtaaagtgaggttgtttattgtcagcctttttttccttaatgtttttctttttttttcttttttaaagattttatttatttatttattcgagagagagagagagagagagaggcaaagacacaggcagatgggaaaggcaggtgccttcgttgtcagtagttctccattctttgatgtgaaaaggggcggcacagtcatttaaacttgatccaaccgctttgcatcttacaaagttaaacagctaaaagaagtaaaataagaaggcaatgcttgtggaatgtacagtgcatattggcggcgcacgcctctttatgatttgcctgcttgcttctcctgttcaatcgtttctttcgaaggcagtggatttttctcttgcgtttctgtcttcttcaatttcaatttaccgaatttctcaatctcagccatatcgggtttgtcagacatggttgcagaggaagcggagcgaggcgcactagcgagctggtgagaggagagggatccggtctgtgctgcggtcgctgccgaatgccctcctgtatcattctaagttactttattacccccaggacacagggcttctcattgtcatagcaaagttctctatacttaagatctgatattttgatttctgctttcaaagtaagcttatatggcaatcaatattatgtgcatttcactgataaattgcctaaagtcctccaactctaattggatttgaactctagcaacccatgcctctaacattgttttatcctcacccttctccccagctctgtgttgattttttttgacactttaatcctaaatcttttctttaagttttacttctttgacactttttctgtacatgatttcttttctctttttttttagagagagagagaaagctagtgagtgtgggagaggggcagagggagagcgagaatctgaagcaggctccatgcccaggacagaacacaatgtggggctcaatttcatgaccctgaagtcatgtacatgcttttcaatttctctctccttcttcctgttattttccgctgtctggtattgtttcaaactagagagggtttttttttttttttaaattaaagattttatttattcatgagaaagagagagagacacacacaggcggagggagaagcaggcttcatgcagggagcccgacatgggactcgaacccgggtctccaggatcataccctgggccgaaggccgcgttaaacctccgagccacctgggctgccctagagagggttgttaacctatctttagtcacagaccaagaaggtagaagatctgacctgggaatccaggtttgaccacatcattctacctctttctgagatttataaacaaaggaaaagaacataattttcttcctttaataaaacaaatgcttaagagtctactatgttttatgtggtattataatatatactgggagtggagaaatgaacagaggaatactgtgcctgtacttgcagacttaacagttgagtatagaaagcattcaggcacattaataaatagtttcatcaatgtggtggacattcagaataaaggaacattcagtctataaggtatcaaaactctttagaaactattaagatcttctttaatggaagatattttggtgtgctggggaatttgtctttagtgaccagtactgtgcagaagagcattaacaagtatattaaaatcctaaatttgaaggtaaaattctatataaaataaaatgctggaaaatacttccaatggtcttgtgtagagcataggcctctttagaatccccacaacacagaatgtgagaaacaagtgtatttgattacaatgaaattgtgtttcttttaagccagtacatcatagacaaagttcacagacatataacaaattgagaaaagatattttcaaattataaaagtcatgaaagattaatatccataaaatgtaagaaatgcctgccaagtaataagggatgggagcctgaatggaaacaatggacagagaatatgaatagacaacttagaaagggaaagcctgactggctagatacatgaactcaccagtagacactgaaaaacaaattaacataataagaacgttttcttgtaccaaccagaatggccaaaattaggatcatagataaaacaaagtgctctacagtatatgaggtgaagggaacagtcccccaacaagaaccagaatgtagatggttacattagtattggaaagcagtctaggaatgaaattaagtatctgtacatctcatcagtagtactgctcccagttataccttctagagaaataactcacaagatctaaaagagaatgtactctcgatcattaatgtgagctgaaagttgtagtgacaatgccatgtgttgcaaggggagtgaataaatatgctatagttgaagttactgggcaataaatagtatgcaggacttagaagcaactagtgagtccaaggatacattttgaaaatatagttcaaagcaactaaccgggtgattataaagtgatataaataggtcacaaaaataaagtggtaagtgagaaaagtagggaattggactattgcttcatcagtagcctttttcaaaaaaaataagtgaaaagacttatgatcctcaaacaataccacattttctaaagtgatagtagtagatttattttttatttttatttatttatttatttttatgatagtcacagagagatagagagagagagaggcacagagacacaggcagagggagaagcaggctccatgcaccgggagccggatgtgggattcgatcccgggtctccaggatcgcaccctgggccaaaggcaggcgccaaaacgctgcgccacccagggatcccagatttattttttaaagatttatttatttatttatttatttatttatttatttatttgaacaagcaggaagaagagctgagggagagaaacaagcagactctgtacttagcagggagcccaatgcagggctcaatcctatgaccacaagatcatgaccaagagcctgacactaaacagactgagctgcccaggcacccctgatagttgtggatttaaatacacagtccaactcattattgattggatgtcatggtggggtcaccaggaggatttttaaatgtagaaaagtaatatgagcatatgatactgatgagtaggataataaagagggacagattaaagattcagcagggtgggatgattgttggaggtagccccccaaattgataagaagtggggaaatccagatcctggggggaggagttgatctttataatatataatataatataaattataaataaattatataatttataatattacataaagttagttaattttaaagcagcagcagggtttgagaagactgacatcaattctgaaagaagttctgctgtgggtaaaatgctattgaacagcatcccatgctacagagaaatcattcatgagaggaagattcaactgctcctgcagacttcatttttgtcttatttcaaggaatttccacaaccaccccaatcttcaccaaccacaacactataatcagtcagcagccatcaacattgaggcaagatcctccatcaacagaaagattgtgtcttgttgaaagtacagatgatggtttgcattttttttagcaatgaagtattttaaaaaattaaggtatatatatatatttttagacaaaatgccattgcatacctaatagactgtagtgtaaacataacctttatatgcactgggatgccaaaaaattcatttggcttgttttgttgcaacaatcgctttattgaggtggtttcgaattgaacctacagtttctctgaggtatgcttgttattttatttggtggcagaaacctgacgattatgtgtgaatttttttttttttttggtctttccaacatgatgcatagcttctgtggagagagatgtgaagaaattttactttcaaaaaaaaaaaaaaaagaagaagaaattttactttcattttgcatcatgagcaaatttcaatggtttctgtggagaatgggagtgcaagctgatgatggaaagttatgaccagctttgagtaaacacttgaggctggcatctatgatgcatgatagttggtgacattctctagtagaacctccaggtactgagtatcaactttgcttgttatttaaaaatttcttccctcattttatacccttttatttttctattttccttgttatgctttaatttatttaacttaaaactttagtatgtatttttcctctagtaagatattattatgtgttactactaactcatttgatttggattggtaacatcctttttaggttattctttctataattaaatggcttagtttccaaaaattcagtaaaattattattttatcccctactaaaaatgacaaccagtaaagtcaatgatagtctcatgtacactgtaataatccaatatataacataattacaaatatcacaatgttactgagaagttgtgtagctgttgctgaaatacaagaaatataagttttgttaggcaattatgggtacagcatattttccccaaattaattttccactggggaatcttataatcaacaacaataagcacaataacttctgcatcaattattttgatactgtcttgacaaaatggtcacttagaaagtgtgtcagatgctcagtccttgtgtcagaaagaaagcagtaacctagttgctgtgatatccttactgtaataagtgaagaacctttttgtttgcttgtttatattgaagcacagttgacatacaatgttacattagtttcaggtgtacaaaatagtgatttgataagtctatatgttatgctgttcctccaactaaggaactttctttaattactttttttcttttacctctttttttttcgcctcagattttaattccaagatagttaacatacagtgttatattcgttccaggtatacaagatagcaattcaacaattctgtacattactcatcaaaagaatgtcccttcacctatttcacccattctcctaaccacctcccttctggtaaacatcagtttgttctctatagttaagagtctgtttttctgtttctctcttttttttctttgtttattagttgtttttcttcttaaattccacatttgaatgaaatcatgtgtgtatttgtctttctttgattgacttattttacttggcattataccctctagctccatccatgttgttgcaaatagcaaggttgcatttgttttatggctgagtgatatttcattgtatgcattatgtatgtatctatctatctcacatatatacatctgcttccataatttgactactgtaaataaagctgcaataaatatagggttacatatatcttttgaattaatgttttcatactctttggataaatgctcagtagtggaattactggagcatatggtaattccatttttaatttttttgaggaacctccatactgttttccagagtggctgcaccagtttccattcccaaacagtgcataaggttttcttgtatatttctatttttagtttttttgttttagcccttctgataggtgtgagctgatatctcagtgtggttttgatttgcatttccctgataagttgtggtgagcattttttcatgtatctgttggccatctggatgtcttttttggagaaaggtctgttcatattttttgcccatttttaaagtggtttatttgttttttggcattgagttgtaaaatgacttttggacactaaccttttatcagatatgtcatttgcaaatattttctcccattcagtaggatgtcttttagttttgttgattgtttcctttgctgtgcagaaattttttatttcgatgtgatcccaacagtttatttttgctttgtttcctttgcctcaggagatatatgtcagagaagttactgcctgtggtctcatctaggattttcttggttttgggtcttatatttaggtacttagtccattttgattttatttttgtttatggtataaaacataacccattacattcttcacatgtaattgtctggttttccaattaccatttgttgaagagactctctcccactgaatattctttattctttgttcatctttaattgactttatttctgacctatctattttgttccacgaatgtatgtgtctatttttgtgccagtatcatactgttttggttacttcagctttgtagtatatcttcaaatttgagactgtgaatttgtcagttttgttcttttttttaaaatattttatttatttattcacgagagacacagaaaaaggggacaggcagagacacaggcagagggagaagcgggctccatggcgggaacccagtgtgggacttgattccggaactctaggatcatgctctgagccaaagacagacactcaaccgctgagcaacccaattgttccagtttttttttttttcaagattattttagctttgaaggtttttgtagttccatacaaattttggggttatttgttctagctctgtgaaaaaggttgctcatattttgatagggattgcattgaatggatagattgctttgggtagtatagaaattttaacaatatttgttttgcaaatccatgaagatgggacatttttccatttctttgtttcatcttcaatctctttcatcagtatttatagttttcagatgctcagatgctacatgtctttcacttccctggttaagtttattcctaagcattttattatttttcgtgtaattgtaaatggacttgttttattaatttctctttttacaactacattagtagtatagaaatgcaacagatttctgtatattgatttagcatccaatgaccctgctgaatttatttatcagttctagtaattttatggtggagtctttagggttttttatatatagtatcatgtcgtctggaaatagtaaatattttacttcttctttaccaacttagatgccctttattcctttatcttgtctaagtggtgtggctaggacttccagaattctgttgaatgaaagtggtgggagtggacatctttgtcttattcctgactttaaatgggaaagcctttcagtttttacccattaaggatgaggtatctgtgggtttttcttatatagtttttattatgttgaagtatatttcttctaaaccaactttgttgagggtttttattatgaatggatgctgtactctgtcaaatgctttttctgcatctattaaaaaatcatttagtttttatcctttcccttgttgacatgatgtatcatatcgattgatttgtgtatattgaaccacttgcatcccaggaataaatctcctcacctgactgtggagaatgctttttaaaaatatgttgtctgcagcttgctaatattttgttgaggacttttgcacccaagctcatcagagatattggtctgtagttctctttcttgtagtgtctttatctggttttcgtaccatggtaatgctggcatcatagaatgaatttggaagctttccttcctcttctatattttggaataattagagaaaaacagatactaagtcttttaaaaaagtttgatagaattcacccatgaagccatctgaactttggtttgttggaagttttttgatttctgattcaattacattactgatagtctgttcaagttttctacttcctcttgattcagttttgggaatttatatgcttctaggaatctacccatttcttttaggttgtccaatttgtaggcatataatttttcataatattctcttaaaatcctctgtatttctatggagccagttgttacttctcttgtttcattttccattttgtttatagagccttctttctctttactcttttttgatgaatctagctaaatgtttatcaattgtgttgctcttttcaaagaaccagctcctggtttcattgaccttttctgttttttgtttgtttgtttgtttctgtttcatttatttatgctttaatctttatttcctttttttctactacttttgggttttgtttgttcctcatttctaactccttaggtgtagtttaggttgttggagatttttcttgctttgtgaggtaggcctatattgctgtaaacctccctcttagaaccacttctgctgcatcccaaagatttgaaaatactgttttcattttcatttgtcttcatgcattctttttaattttccctttgattttttggttgatacattgccattttgttatttagtctccaagtattatgttcttttcagattttttcttatggttgacttctagtttcatagtattgtggtcagaaaagatgtatggtatgacttttacattttgaatttgttaagatttttttgtggcctaaaatgtgatccattttggagaatgttccatatgtatttgaaaagaatgtattttctgctattttaggataaaatattttgattatatctgttagattcatctattccaatgtgtcattcaaagtcattattttatttcttggttgctattctgtttatattatctatccattgatttaagtgaggtgttaaggtcctctactgttactgttatctgttactatagattatttcctttatgtttgttattaaatactttatgtatctgagtactcccaagttgggtctgtaaatatttacaattggtatatcttcttgttggattatactgtttatggttatttagtgcccccttttttttgtttcattaaagtctttgttttaaagagtatttttgtctgatataagtattgctatttcagctttcttttcacttccattgcttgatgaaggtttttgcatcccttcactttcaatctcctagagtctttatctgaaagtattctcttgtaggaaacatatagattgatcttggttttttatcctttcttttgccttatgtgttttgattggagtgtttagttgatttacattcaaagtaattattgatagatatgtgcttattgccattttgttacttattttacatttgtttttgtagttcttctctgatccttctcttgctatcttacagtttgttggttttctttagttatatacttacacttgtttctctttatttttttcatatctattactagtttttgatttgtgactatcaaagactggcatataatatctgcatataacagtctatgttaagttgagaattgcttaagtttaaacccatatttttttagtcctctctctgctcatgttttgggtatatggtgtcatacactacatccttttattttgcggatcctttgactaatttttaagattttatttatttattcatgacagacagagagagagagagaggcagagacacaggcagagggagaagcaggctccacacagggagcatgacgtgggacttgggccttgatcctgggtctccaggatcacacccgggggtgaaggtggcgctaaaccactgggccactggggctgcccctaatttttatagatatatctaattttactacttttgtgcttcttacttttcttattcctgtttatggtttttcttttccacccaaagtgtccactttaacatttcttgtaaggctagtttagttgtcatgaattcctctaactcttgtttctctggaaaactatctcttgtatctgaataatagcagtgctggatagagtattcttggctgtattagcacttatttagcactttgaatataccatgtcactctctcctgacccgcaaagtttctgctaaaaaatcagctaatagccttatgatgtttcccttgtgtgagctattttcttttctcttgcttctttttaaaactctctcctttccattactttttgccattttaattactattatcttttttctttaaatattttatttatttattcatgggagacacacacagagagaggcagagacacaggcagagggagaagcaggctccacgcagggagcccgatgtgggactcgatcccaggactccaggaccacgccctgggctgaaggcaggtgctaaaccgctgagccacccagggattccccccattttaattactattatcttggtgtggacttccatgggttgaattattggggggctctcaatctggatttctatttcctttctcagatttggaaagttttaagctattatttctttaagtaaatttcctgccccctttgtactctcttctccttctgagatgcctataatgtgaatgttactatgcttgatggtgttgctgatttcttttttttctttttctttttttattttataaatttattttttattggtgttcaatttgccaacatatagaaaaacacccattgctcatcccatcaagtgcccccctcagtgcccgtcacccagtcatcccaaccccctgcccacctccccttccaccacccctagttcgtttcccagagttaggagtccctcatgttctgtctccctttctgatatttcccactcattttttctcctttcccctttattccctttcacttttttttatattcctcaaatgagtgagatcataaaatgtttgtccttctccgattgacttatttcactcagcataataccctccagttccatccacgtcgaagcaaatggtgggtatttgtcgtttctaatggctgagtaatattccattgtatacacagaccacatcatctttatccattcatctttcgatggacaccgaggctccttccgcagtttggctattgtggacactgctgctataaacatcagggtggctgatttctcttaatctattttcatttcatattcttttttccctcctctgttcagctggattattttctaatactctgtcctccaggttgctgatctgtcattttgctttctctagtctactttttcccttctagtatatttttaagttcagttaatgagtttttcatctctgattggttctttttctgttttctatctctttgttgagggtttcactgaggtcctcccctcttttctcaagtccagtgattatctttatggccattactttaaattttctattaggcattggggatccctgggtggctcagtggtttagcacctgccttcagcccagggtatggtcctggagtcccggggtcgagtcccacgtcaggctccctgcatggagcctgcttctccctctacctgtgtctctgcctctctctgtgtctctcacaaataaataaaaacattttttttctatcaggcattatttatctctgttttgtttagctctcttgtaatttagccctgttctttcatttaggacatattcttctgtatcctcattttgtttaattcctgtgtctgtttctatgtgttaggaaagttagctacatctcctgccttcgaaagtagtggccttatgaagaagaagatgtcctgttgtatcctgcaatgcactgtctcctgttcagaatctgatgtttctgggttgtctcctatgtgtagtgcgtgtaccctactgttgtgggtaagccatgtttgccttcagtccaatcatctgcaatgggtctcttagcctattgtgggcagagtttgttatctgtgttagtgggccagtctggaactgccccaggcttgaattgaattagaccaggtattatccagagctatggctacaccaaattccagggagtgctctctgtattgtcccccaagaagctttcattggtgggtgggccctacagtcagatcagatgtccacctcagcccattgctggctttgcagtagaactggtgtgagtgtggttttctttccttctctcttaggcaggagtcagtctgaggtggtgttggcttctgctggggctctttgcacactgccatacttgtgacaccacttacgatggagtctggctaaaggcatgttggatagaatgggtccacaggagaatacaagggtggggcatgcagtgctagcaaggtccgtgcaggtttattgtgggaggctgcatcttcctcagaaaactgctgaagctgagatggggctagaggggtaatatctgctgaaaagtgcaggggtgggtgcactgttagtaaactaggtgaggagtgttcagactgtgctggttcccacaggtgtctatatatatatacatatatatatatatgtatatatatataggctgggggtgtaggggagggcattggagcctgccagcccttttattcttagaaaagtttcccaaagatccgtgccccatcagcatatactgtaagattactgaacagatctgccttctttcccccatatactccaggtgtttttcagactgctgcttctctgctgtatctcagcagggctatttgttgtactgtctccttaagcagggactcagtttcctatcaccctctggctttcctagaatcaagcactctggtttttaaagttccaggtgttaagtctcaaggattgtaagaatttttaaagttaggccctctggttttcaaagccaaatacagggattcatctctcactgtgggtcactcatgtcttgggtgcctagtgcggggtttgctcctctttcctctccatcccagtggtgtctttttctcccaggcatagtctcataagtcagtttggttcctgacctctctctttgatgctacgttcagctgtgaaggctctgttctcccagttttggggtcatttgctggattatttatattgatgtgggtgtaatcatgggacaagttaagtctagggttctcctactccaccattttccctggaagttgtctatttcttgcagagtttctaaaatatctgtatcaagttcagattttttatagtttagatatgcatttattgaccatatctgtgtaatatttacattttggagacacatatataggtgtttattctttttctatttttaaaaaaaatttaaaaggattttgtttattcgagagagagagagagagagagagagagagacagagacacaggcagagggcaaagcaagctctatgcaaggagcctgacatgggattcgattccggatctccaagatcaggccctgggtgctaaaccgctgagggctgcccagctttctcatttcttactctaccttttctaacctatggtcatctttgtcagttgctatccacttatttgaaaaagaatatgtgatttaaagccatgactttttttttttttttttttttttttttttttgttaatcaatggaattttggtctacaaattcatgggcaaatgcttcttgattgcataaaaaatacttagaaagattagggatttcatgaacaattgaaaataaattgccactagaggaatcaattacagaattttatttacctttgtatattgaataacttaaaaatagagaacttattagttagtttagaaaatattaattagggaagaacctgttggaaattattttaacttattacattaatatattaataaactatttaccacatttaggtcgaatctatcaccagtggccaatgatttaatcagtcatgtctttgtaatgagactttcataaaaacccagacagaggggtttgggagagctttccagattgagaaaccagattgcttccgcgtatctccatactggtctccaagcaccaggaagacagaagctcttttgtttaggacctcaccctatttctttatctgccttttgatttgaatcctttagtattctttgtggtaaagcagtaatctggagagtaaacaggtttcttgagttttctgatcctatcaagcaaattaattgaatctcaggaagggtttgtgggaactcccatttgtagcagatctgtcagaagtacatgtaacaatctggacttttgattgccatctgaagtgggggcatctgaaaggggactgagccctttatctgtgtaatctaatagtatctcagggcagatagtgtcagaattgagttgaattgtagggcaccctgctggtgttcagagacttcttggttggtgtgggaacctctccccaacattggaaattttatacagaatcagagtgttttgttgaactatgattactatacagatatactcagtaatgctctgtcatcctaaacattttttccctaatatgttgctttgattctaatgatttgctgaggatgctccagaaaagaggaaccaaggaattttcagaagagatgagactataataattagtaaaaagtcattttaagagttgatgcatcttggaaatttcatgttctttcattttgaaagaactctgtggagtcaagttaattgcttttctgggatgtaacttttatatccgaaagaaagagaaaatgaaatactttatggtatgatattattgcatttaaacattggatcctgtttatctccttctaccttttttctttttgcaaaacctggccttttttttctccatatagatttctctgctattctattgtaaaaagaattttatttgttgtttggtatatgctgttttagttaattggttctggcagacttttaggaatctccaaaattgctgattatggagaggtaaacgttgtagaagaaaaacagttaaattgagatttgtaaggttctacaggataaattttggcctcccctataattctcagacttagcaccatgctgtattacagaaattcagttataataatgctgattatatatttattgttttctttctttgttcactgtctctgcaatgagattttaagaagttccataagggcagatgccaagtctatttcacttaatactatcactgcgcctggtatataatgagtcctaagtagatactgaatgaaggacaacaatgtggactagagccttggagtgagaattgcactggagctatagataatggcagttaatatcacagttggacttacagatgtggaagaggttgctcaggcaactggggaggggaagaatctcatgaaagagttctgaaggagcacaaacatttaagaaataggaagaaggtcagagtaatagtgatattgatacagggcaagagaggtgagaggaaaataaagagagtccactgtgatgtcaggggaaagagtgctataagaaagaaggagtggataccaaacgagattattcagaggtgaagtgaagattaaaaaacatgaaatcacattagctttgtgtggtaagtggagatggaaatcaggttgtggtagacagagaagtgactgttcaaacaatagaggtaaggagtaaggacaactgataagtttagctatgatgtagaggagaaagggcatgactgggttggaggaggtagagataggtcatagaaagatttaaaaatttatataatgatgttgacatgtttaaatgtaatgggtagggtgcctgagtggctcagcagttaagcatctgcctttgggtcaggtcatgatcctgagatcttgggatcaagccctacatcaggctccttcttcagtggggaacatgcttctccctttttctctgcctgcctctccacctgcttgtgctctttctctttcttcaaataaataaaaatgaaattaaaataaatgtgaatgggtaagatccaacaaaagggagaatttgaagatattggaaaggcagacatttcaggtccgtaggtctctaaagtgggtaaagtggcatgggatattgaacccagtgaaggagttgatttttgaaaggtagagtatttctatccttgtaatgggaagagagaaatgaatgtatttcatttgcagattatttggtggcagaaactgagggataatatctgatgttttaaaatatctctgaaatatgcggcccagaatttactgaggagtatcgcagtgatatacttttttaaaatttttatttatttatttatttatttatttatttatttatttatttatttatttatttttagcatgactttgcttttgaaagcttctgtaggtaatgggagaacaagttgcttagggaaatatagaataattgtgatacagcttctagtattcatctgattttagagtctatgaattaatggtgttactgctatgtatggttatatgatatttctagcagaacactgcaatccatttgtaagtgtgcagaaaatgtttgaattgatccatgaggtgattttgtcaagctgttatggtgtcaggggtaatgaagactttctcctctaagttataaatggactaatcatgtaatttaattggaggataaaggaactgaagctccaggaatgttaaacaacaatggagaaattagaaggatcatgaaattgaagacatcagcagagtcaaacactgacatgtgtagaacccagtgatagagctagaaggttaagtgtctcagaagtctgatgcttagggatgttgagaatatccaaaggtagccacatgaaagggtgtccgaggtgaatatttacattctctggtaatgtggaggtctatctttagagttggggatattggctgagtcatctacctgaatctgaagtcatttaggatgtccactagactttcaggggaaagtaaaacagtgggtcctttatcactcagagaatgatgtgagaggaccaagaaattaatagatatacaagaaaaggggtaggtggttgcactgctaggattaaggaaacagatatcttatacgtggcagggattttttattttaacaatgaccttgtcatattctagaattgtcatattctagatatgacaatgatactgatgattcttgggaaaattactgactcaatctttttagtaaagcttagagctgctccattctgtattaaaagccagaatcccagtcagtcaatataatatgttcctctacttaatctcttccagtttcaacaatcctccaagttgattaagctagtcattaaatcttttgaaaacaggtccttctcacctccactgtcactgcccttatttggtctgcaggtatggatgtgatatttctagtcttcaccacttcctggagttgttagctatctggatttctccccctactcttagcctccttcagtatgatatcctaccttgactctatcccttgtatactaaacaaacattgctaatattctgcctgcttggcgtcatggtgaagcccatatgcttttctttgaggtctggttcacttataagctggtcacataattccatgtgttctctttgaaagctttcatgtagagaaaaagtaactcatgtattgttggtaggaatgtaaagtggcacagtaattatggaaagcagtacggtggttcctcaaaaagttgaaaatagaactaccatgtgaactagctatctatctatgtgaaccatagaactatcttatgatccagcaactgcctctctgagtatatatcagaaggaagtgaaatcaggatcttgaatacatgtctgcattccagtgtccattttagtattattcacaatagccaagatacagaaacaacttacatgtcctttgacagaggaatagtaaagaaaacatatatgtatacaatgaaatgttattcagcattaaaaaaaaaggaatttctgttatttgcaacaacatggatgagtctggagggcattatgctaagtaaaatcagctgggcagagaaagacaaatgctgcatggtatcacatgtgaaaatctaaaagaaacaaaataagagtcggtttcttagaaacaaagaatagaatgggttgctaggactagggagaggggacaatggggagatgtaggtcaaagggtacaagctttcagttataagaagttctgaggacataatgtacctcacggtgggactatagttaatgaatggtaacaaatacttttgaaagttggtaaagaggatctaaaacattcttatcacacacatacaaagagttaactgtgaggtgattgacacgttaattatcttgatcttggtaatcattcacagtcttggtcattagtcaaaatgtatatgtatatcaaatcatcatattttgcactttaaatttttacaattatatttgtcaattatttctcaaagttgggggaattttttaaataaaactctaattatgctttttatttttttttataattttttaaaaaatttttatttatttatgatagtcacagagagagagagagagagaggcagagacacaggcagagggagaagcaggctccatgcaccgggagcctgacgtgggactcgatcccgggtctccaggatcgctttttatataacttttataagattaagacttataccataacctattatgttcttaattaggccccacacacttccctgtcctattcactccagccccacagtggagatcagattaaattctatggattttagagatctttttattataaaagccttttgaatatttttttctatcttagttaagataggagctaggtattgactgacttccaggatatatatatatatatatatatatatatatatatatatatatatatatatatatactgctcactatctaccaaatctgacaggtttctggtcaatagttgtttgctcattttgtagtcttttaagttattgtattacttcagagctgttaatattgttaacaatgctagtgctgtacaattttgaagtctgccttcccaaagttcatatttatggtaacttttagatgtgtcttccttatttaccacaacatctaagtttatgtgatcttttgccaaaattttaattattttctcttactagtacaacctatttttctttgcataagttaggttgggagtagtactcctatttgctttttctacccatggtaagatgattaaagtccatttgaatttgtttaactttgttgtttctattttcttaccccacttacttttattttctactatttttccattccattagaaaaatggtatcctttccaattataccctatcgattttgatatccaggagaaatatggagatggccagttcttctattcacttcctttattatctaggcttctgatatactttggggaactaggtataaggtttataaatttccttatgatttttcttcctcatttcttctgtttctgttttctttacccagttttaactcattttatttaaattctttgaatattttcttattcctcttctcaagaacataacttgatacaatggtaaatgttttcagcttaacttttctacaaatcagtgaagtttggcttcaaggtaattattaataatttagtaaaattcttatcttgtgccccaatgacaatgacaaccttcaaagttagtagaaggcccataggactataatagtcattgagtagtgaagttacaaataaaataatgtacttaccaataggaggtgctgcttttgttgaaatataaacataaacaattatttgttaacttactattggacaacacattttcctcttaatctttcaacagtaatcttatgaaatgatacccaagcagcacaaacacttttgcaatcattattttacatctttaaatcctggccaaatggttctttatggggtatgtgccatacttggtgttaagatcggagaaaactgtggtgagattctcatttcatcacccacttgctgtggtggcccctttgtgacatccctgctgtgtgagaagcttatgactaggactctttattgaaagggaacccattactttaccctatttcctatttttaactttgaccaacttattcattttttcttcctggcctctcaagtgatctttctctttattctcaaatgttgactcttttctacataggttccattctatatttttttttgaaagtagttcttgattgttttgaggaatatatcctcttagttacttagtacatttaagtttttcagcaaactgtgggcaatctctaaaaattctcactaatggaaatgaagacataataagaaatactaacaagaaatttcaaatttgccagagaaataaaattgccatggaaattttaaaaatcttcatgcatttatttctccagaaaccacttgtattgagaaatagaaagacagatttattaccttaaggacagatctattactagttcctaaaccataatcagatatgagactatagtttaatttgcagattacactaatacacttctttgaattattttaatatccaatttccttagagtaccaaagcttccatagcatttattaaggcctatttaggaatcacacattgatttgcagtttgtttacagttataaaattaaaatttctttcttaattagtaagtttttgagtatgagagaaaaggcaaaggatatttaataaaattaattttagcagcattggacatagatgcaagtggattcagccaaagtacaccacagccaaaaagtgaaatgaccttggagtaaagacatggaaaaggaacttaccactggctctcccaactctatctgtaataaaagcaatgaataaatacaaaaattcttcaatgtaactttttccttgaataccaaatacatacattatactgattgattaacatgtgcccaggcattgtttcaagtgtttaactattttaatatccacagaagtcccatgaggtggctattattgttctcttcattatccagtgaaaaaactggggagagatagacatctcttaggcatctacctaaaataagacatcacttaaatggcggggcctgaatttatatctaagcaccaaaacctcagagcctaaacttttatggtcttttctttatgtattgtcctgattctttaaagtgtcagctttaaagttggctgctttggcactataattggagacagcaaaatctgtttaaacgttaattctttgagtttctaatacatgatcctccatgatcctttttttttattttttattttattttttattaactgtctttaatattttctgaggcagagaagattattaacttatttgcagtcactgatcaaataagtagtgatctggtattccaatccatgcttgtttaacttcaccttatatgccttgtagaagcgagagaagatttttttttctgattataaaactagtgttcaataagtgtctataatatttgaggcatcatactaggtgctttcccccctgccctcccaaagactacgtctgtgggaggaactgggcatgttattgcagtaattgcactcatgttgaaagaactcactaaaggcaccacaggatattgaaaacaaatgccacattacctttttttttttttctcagtctttctaaggagttagaaccttttaggaagtatgtgctctctctttttagaagatagtctgctgtaatgggaagatctgtctttatggagtcagctggtatagtgggaaagagaatgggcagatgaatgaaggatttaaatgtgaaagttaaaatgtggaagaaaatgagagatcatcttcaagatcttgcatgagggcaaggatttctttgaacccccaaagtacaaaccataatatgaaaaactgccatatgtgagcacatgcaaattaaatatttcttttcaacgagaacatcatacttaatagattagagaaaatagttttaagtccaaaagtcacaaagaattaatattagaatatagaaggtgttatgagctgaatgtctgtgccctcccacccccaattcatacgtagaagcttaaacctacaatgtgatgctattaggaagtggggaggtaattaggtttagataaaattgtgagggtaaagttctcatgatgaaattaggattctttaagaagatacctcagagaatggaaggagacaataagaagtggctgtctacacaccaagaaaagagggccctcatcaagaatctgaccatgctggcatcatctcagacttctagtctgcaaaaccatgagaaatgtttgttgcttaagccactcagtatggtagtccattatagcagcctgagctaagacagaatggatggttggttataaaggaacatgaaacagataagaaaccagttagagaaagaatgatgagctcatgctcatcatgctatacgttaatggctaatattggctaatatggctaacatataaagaaacgtatgaacaacttatataaattaaagacaaatacctttgaaataccctaaataatttgaaatgataaatatttaaatgtaatcacccaatgttgtgcttaattctggttttgcttcacagctgtaggattttaaatatgttctttgatttcagtaaatctgtttcttcatctgtaaattctgtcagttagtatgtgtctcatagaattcttatggttttaagagatacatttatctaacgtgcctgacactttaaaaatgtttgatttaagttgctttcctttccattttctccattctcttttgatacataccattctctgctcctcagtgttcaaatatttaaactttgctgcctggactgaaattaaaaacaaagttccctcaatcttcctgtttaccagagagccactctaatcaatcccaggatttattctgcttttccttttttgcctatgggctttttatttttgaaaaaaaaaatcggtaacttttgaggagactgaattcattggaaataaaatattgagcagaacatgagcatcttggtgaaaattgcaagtttaggagtttcccagacagattagagaacaccaaaattgagaaccaaataactttatagatcttggatactagcactttatctgatgtgtcatttgcaaatatcttctcccattctgtgggttgtcttttagtcttgttgactgtttcttttgctgtgcagaagcttattaaactcaacagcaaagacacaaacaatccaatcatgaaatgggcaaaagacatgaacagaaatttcacagaggaagacatagacttggccaacaagcacatgagaaaatgctccgcatcccttgccatcctggaaatacaaatcaaaaccacaataccacctcacaccagtgagaatggggaaaattagcaagacaggaaacaaccagtgttggagaggatgtggagaaaggagaaccctcttgcactgttggtggaaatgtgaactggtacacccactctggaaaactgtgtggaggttcctcaaagagttgaaaatagagctaccatatgacccagcaattgcactgctggggatttaccccaaagatacagatgcagtgaaatggcaggacacctgcaccccaatgtttatagcagcaatgtccacaatagccaaactgtggaaggagcctcagtgtccatcgaaagatgaatggatgaagaagatgtggtttatgtatacaatggaatattactcagccattagaaactataaatacccaccatttgcttcgacgtggatggaactggaggatattatgctgagtgaagtaagtcaatcagagaaggacaatcattatatggtttcactcatacggggaaaataaaaaatagtgaaaagggattacaagggaaaggagagaaaatgaatgtgaaaaatcagaaagcgtgacaaaacaagagagactcctaactctgggaaacaaactaggggtagtggaaggggaggtgggcgaggggttggggtgactgggtgacaggcagtgaggggggcacttgacgggatgagcactgggtgttatactatatgttggcaaattgaactcccataaaaaaataaataaataaaaaagagaaccaaacaccttaccagaaaatggaaattcatcaaaaaaaggaaatagggagggggggcacgatggcggaagagtagggtctccaaatcacctgtctccaccaaattacctagaaaaccttcaaatcatcctgaaaatctacgaattcggcctgagaattaaagagagaacacctggaatgcaacagtgagaagagttcacgcttctatcaaggtaggaagacgggaaaaaagaaataaagaaacaaaaggcctccaaggggaggggccccgcgaggagccgggctgaggccggggcgagggtccccaggataggagagccccgtcccggagaagcaggagctgcaccgaccttcccgggcggaaaggggcccgcggggaggtggagcaggacccaggagggcgaggatgccctcgggttcccgggaaaaataacaggcacctgcgcccctggagagtgcgccgagctccctaagggctgcagcgcgcacggcgggacccggagcagctcggaggagctcgggggcggctccgcggaggcggctgcagggcgggagcagctccgggggctcgggggcggctccgcggagggggttgcggggcgggagcgcgaatccaacagcgcaggactcggagcacagggcgccgggacacagcccaggatcccgcctccccccgggacaggcagaggccgggagggcccaggacagcgaggacgctcctgccccgagctgaacagagcagcggccccgccccggagcctccaggccctgcagacggagagctctggagttcctgcgggcgctgaatccagggctccagagctggccccgccactggggctgttgctcctggggcctcacggggtaaacaacccccgctgagccctgtaccaggcaagggcacagcagctcccccaagtgctaacacctgaaaatcagcacagcaggcccctcacccagaagaccagctagactgacaacttccaggggaagccaagggacttaaagtacacagaatcagaagatacttccccgtggttcttttttttttttgctttttgatttgtttccttcccccaccccccttttttctccttcctttttctttctctttttcttcttcttttttttttttcgtttttttccttcctttttttttctctttctcttttctttccttctttctctcctctctttttctccttttctcaatacaacttgcttttggccactctgcactgagcaaaatgactagaaggaaaacctcacctcaaaagaaagaatcagaaacagtcctctctcccacagagttacaaaatctggattacaattcaatgtcagaaagccaattcagaagcactattatacagctactggtggctctagaaaaaagcataaaggactcaagagacttcatgactgcagaatttagagctaatcaggcagaaattaaaaatcaatcgaatgagatgcaatccaaactagaagtcctaacgacgagggttaacgaggtggaagaacgagtgagtgacatagaagacaagttgatagcaaagagggaaactgaggaaaaaagagacaaacaattaaaagacgatgaagacagattaagggaaataaacgacagcctgaggaagaaaaacctacgtgtaattggtgttcccgagggtgccgaaagggccagagggccagaatatgtatttgaacaaattctagctgaaaactttcctaacctgggaagggaaacaggcattcagatccaggaaatagagagatcccccctaaaatcaataaaaaccgttcaacacctcgacatttaatagtgaagcttgcaaattccaaagataaagagaagatcattaaagcagcaagagacaagaaatccctgacttttatggggaggagtattagggtaacagcagacctctccacagagacctggcaggccagaaagggctggcaggatatattcagggtcctaaatgagaagaacatgcaaccaagaatactttatccagcaacgctctcattcaaaatggaaggagagataaagaggttccaagacaggcagcaactaaaagaatatgtgacctccaaaccagctctgcaagaaattttaagggggcctcttaaaattcccctttaagaagaagttcagtggaacattccacaaaaacaaggactgaatagttatcatgatgacactaaattcatatctctcaatagtacctctgaatgtgaacgggcttaatgaccccatcaaaaggcgcagggtttcagactggataaaaaagcaggacccatctatttgctgtctacaagagactcattttagacagaaggacacctacagcctgaaaataaaaggttggagaaccatttaccattcgaatggtcctcaaaagaaagcaggggtagccatccttatatcagataaactaaaatttaccccgaagactgtagtgagagatgaagagggacactatatcatacttaaaggatctattcaacaagaggacttaacaatcctcaatatatatgccccgaatgtgggagcagccaaatatatcaatcaattattaaccaaagtgaagaaatacttagataataatacacttatacttggtgacttcaatctagctctttctatactcgataggtcttctaagcacaacatctccaaagaaacgagagctttaaatgatacactggaccagatggatttcacagatatctacagaactttacatccaaactcaactgaatacacattcttctcaagcgcacatggaactttctccagaatagaccacatattgggtcacaaatcgggtctgaaccgataccaaaagattgggatcatcccctgcatattctcagaccataatgccttgaaattagaactaaatcacaacaagaagtttggaaggacctcaaacacgtggaggttaaggaccatcctgctaaaagatgaaaggctcaaccaggaaattaaggaagaattaaaaagattcatggaaactaatgagaatgaagatacaaccatccaaaatctttgggatgcagcaaaagcagtcctaagggggaaatacatcgcaatacaagcatccattcaaaaactggaaagaactcaaatacaaaagctaaccttataccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccattagccagctcttattaaaaagaagagagagaagactcaaattaataaaatcatgaatgagaaaggagagatcactaccaacaccaaggaaatacaaacgattttaaaaacatattatgaacagctatacgccaataaattaggcaatctaggagaaatggacgcattcctggaaagccacaaactaccaaaactggaacaggaagaaatagaaaacctgaacaggccaataaccagggaggaaattgaagcagtcatcaaaaacctcccaagatacaagagtccagggccagatggcttcccaggggaattttatcaaacgtttaaagaagaaaccatacctattctcctaaagctgtttggaaatatagaaagagatggagtacttccaaattcgttctatgaggccagcatcaccttaattccaaaaccagacaaagaccccaccaaaaaggagaattacagaccaatatccctgatgataatggatgcaaaaattctcaacaagatactggacaataggttccaacagtacattaagagaattattcaccatgaccaagtaggatttatccctgggacacaaggctggttcaacacccgtaaaacaatcaatgtgattcatcatatcagcaagagaaaaaccaagaaccatatgatcctgtcattagatgcagagaaagcatttgacaaaatacagcatccattcctgatcaaaactcttagagtgtagggatagagggaacattcctcaacatcttaaaagccatctatgaaaagcccacagcaaatatcattctcaatggggaagtactgggagcctttcccctaagatcaggaacaagacagggatgtccactctcaccactgctgttcaacatagtactggaagtcctagcctcagcaatcagacaacaaaaagacattaaaggcattcaaattggcaaagaagaagtcaaactcttcctcttcgccgatgacatgatactctacatagaaaacccaaaagtctccaccccaatttgctagaactcatacagcaattcggtagcatggcaggatacaaaatcaatgcccagaaatcagtggcattctatacactaacaatgagactgaagaaagagaaattaaggagtcaatcccatttacaattgcacccaaaagcataagatacctaggaataaacctcaccaaagaggtaaaggatctataccctcaaaactatagaacacttctgaaagaaattgaggaagacacaaagagatggaaaaatattccatgctcatggattggcagaattaatattgtgaaaatgtcaatgttacccatggcaatatacacgtttaatgcaatccctatcaaaataaatggactttcttcagagagttagaacaaattattttaagatttgtgtggaatcagaaaagaccccgaatagccaggggaattttaaaaaagaaaaccatatctgggggcatcagaatgccagatttcaggttgtactacaaagctgtggtcatcaagacagtgtggtactggcacaaaaacagacacatagatcagtggaacagaatagagaatccagaagtggaccctgaactttatggtcaactaatatttgataaaggaggaaagaatatccattggaagaaagacagtctcttcaataaatggtgctgggaaaattggacatccacatgcagaagaatgaaactagatcactctcttgcaccatacacaaagataaactcaaaatggatgaaagatctaaatgtgagacaagattccgtcaaaatcctagagaagaacacaggcaacaccctttttgaagtcggccatagtaacttcttgcaagatacatccacgaaggcaaaagaaacaaaagcaaaaatgaactattgggacttcatcaagataagaagcttttgcacagcaaaggatacagtcaacaaaactcaaagacaacctacagaatgggagaagatatttgcaaatgacgtatcagatgaagggctattttccaagatctataaagaatttattaaactcaacaccaaagaaacaaacaatccaatcattaaatgggcaaaatacatgaacagaaatctcacagaggaagacatagacatggccaacaagcacatgagaaaatgctccgcatcactggccatcagggaaatacaaatcaaaaccacaatgagatcccacctcacaccagtgagaatggggaaaattaacaaggtaggaaaccacaaatgtttgagaggatgcggagaaaagggaaccctcttgcactgttggtgggaatgtgaactggtgcagccactctggaaaactgtgtggaggttcctcaaagagttaaaaatagacctgccctatgacccagcaattgcactgttggggatttaccccaaagatacagatccagtgaaacgccgggacacctgcaccccgatgttcatagcagcaatgtccacaatagccaaactgtggaaggagcctcggtgtccctcgaaagatgaatggataaagaagatgtggtttatgtatacaatggaatattactcagccattagaaactacaaatacccaccatgtgcttcaacgtggatggaactggagggtattatgctgagtgaaataagtcaatcggagaaggacaaacattatatggtctcattcatttggggaatataaataatagtgaaagggaatataagggaagggagaagaaatgtgtaggaaatctcagaaagggagacagaacgtaaagactgctaactctgggaaatgaactaggggtggtagaaggggaggagggcggggggtcggagtgaatgggtgacggcactgggggttattctgtatgttagtaaattgaacaccaataaaaaataaattaaaaaaaggaaataaaaataaagttatgctttatagatcagtgaccacttattaaccaaatttgggagtcaaggtaatgtaagtcatcttttaagagaattatccacatttcagagtcactcagtctatttatatatttttgggatggtcagcattctctgacctaatctgagagcaatgcttgttttttgatttttataaaaccttaatttggtaagtcttcagggtatggcaaattagaaatagcatgccatttatttactaaagaatgaaaatgacctgatatatgcctggataaagctaatgtaagacaaattcttttgtcttctattagtaaagtctcattcttaaaaaaacaaaacaaaacaaaaaaacaaaaacaaaaacaaaaaaaacactgcttccagtccaaataatcagaccaaggttaaagaagcaaatccaaagctattattaagaataaagaaactaaatcatgctagatcttttctgtacactttatgccaaaatgaattccagatatattaaagattaaatagaaaaataagttataccaaatagaagaagaaacacaaacttttaaaaaatattttattaatttgtttattcataagagacatacagagagaggcagagacataggcagagggagaagcaggctccctgcagtgagcctgatgtaggccttgatcccaggactctgggatcatgacctgagccaaaggcagttgctcaaacactaaaccacccaggcatccccaaacacttttcacataatcttggagtggagaggtactctccagccatatgcagaaacccccaaaaaagattaacttcaaacttttcaatgtaaaaaaaatcatttatttattgatagcatattagaagatatttgttttattaacttcttaacacattaaatgagttattttataagatcaaatattacataatacaaaagattttaaatgtcactgaaaagactccttaggtaactaaccaaataagaaaaataatctcatgggtaatatgttttagagacaaagggttaatattaattaatataaaaagcttttacaaactaataaaagactaagtatatgaataggcatgtcacaaaagaagaaatacaagtggacaaaactgtaaggaaaatcttcagcttaaatagtaaacaaataagagattaatactattttcatctctctagttgacaaagatttaaaaaattgctaatatttggtgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccccacatgccactgaaagatcaaaggtacaatttggctgacaagcatattaggacataagaaagaaaaaaaaaacttcaaaaattactctatcccagtttcctctcggttattaactatcatgttacaaatatttcaatctttaatcatgaaaattaagatgatttggactgcattagaagaaattacagatttgcaataaggaggacaagccattaagagagaacaacatataggagtttgatacataatgaaaaatgtatggaacttcgaaataaaaatggtgggttaacacatgtacctacttgaactctttctgtaagtgttctaaaataacaatgaaggaatttttaaaaaatgtttgagcttacaaagcttaaaaagaattagagaagattacaaaccttgggaggagtggctatttagcagataaattaaggaaggctgaatcctaaatggagaaagtcaagaagcaacctactttcactacagattccccaccatcctcaaaaaagtttcaggatttggcaacagcatcattaaataagatgactacttggtagtggaattgccatgtcaagtacaggaatatctacagcttcactaggtaatgtcaaaatgatttccaaagtggttttactgataactctgttatattgggcaatatctcctttgatttttttagttgagttcttttcttttgtattgttatagtatcaaggcatggtattatgaggtaatctaatctctgagtcagagaatgttagggacttactctccttttctgggctttgctgtgtcattgtctgcggactaaataaaagttaggaactatatgattgcaaaatgtttcttccacttcctctgtattttctatttctccaagtaaaagcatagaagtctctttcctttggtcttcttacagtagctacactgtggtgagcatagcataatatatagacatactgaaccattatgttttacacttgaaaataatgtgtcaactatactcaaaaattttttaaaggtattagggcagccctggtggctcagcagtttagcgctgccttcagcccagggccagatcccagacacctgggattgagtctcacatcaggctctgtgcatggagcctgcttctccctctgcctgtgtctctgcctctctctctctgtgtctctcatgaataaataaataaaatcttaaaaaaaaattaaaggtattaaatggaaaagtgaagaaaccagaagaagtgaaaacttgaaattaattttcatcataaggtaaagggtgcaaataacctggtcatggtctagtttaagtagcatcatttgaaacaagaccttaggacaagattaaaattagacatttttcattcttcccaacatgatgatcagaagaaggagacactggaagaccttctgtttctatgactttgggaatgcttctttgtttctgacagacttggaaccaaaagtacctgaaccattttttcatgtacatgatgcccattgttgataaatctgatatgcttttgggcgaatggcctaagctttctcagtgttctgaaatgtttccttttttcttgaaggaatcataatttctcatagtatgacagtcttctaagtttataagtggaacttttgaagttggctttttaaaaatttagtctagactatatgacaatttttagctgtttatcctcaattatcataaaatctaatctcatgtaatctcttacttttaaaaatacttttttttttattgatacagctccttttgttagtatgaattgggtcaatagtaattctaattctattaagttagtaatagtcaatagtattgggtcaatagtaattcttctatacagtatagtatcttgatatttgatttttttgcactttgttgttttggtttcccacattatttatcttttactttttaggatttctcttcccattctatttgtaatattattcctaattgattatattcttttaattttgataccttagaagaaatataagcatagtcaattcttttaatttctttaattgttcagacttctaactaaatttttggatcctgtgtgtatgatttagaagattcatagaggcttttgttaaaaattatccctcttccttgtatttttcttttcttttttccccccttagttccaacttatttattttgctagttaaggacattcttctttgttaatggcaagtcagctgacttgatcgaatgatagtgcacttctatgtttattctttctataaatcctttgggtttagtttcaagataattgaattgaattgataaataattcagtaacacagtaaaattcttggcttttcctccagtgaaaaacaatgataatagaacttaattatagtcctgtgcatgtagcaacatactattgcagtcgacttataaacaagatactgtacttacaaggaggtggtggagcttttgctaaaataaaaacaattattattattattattattattattatcatcatcatcctagctgttaagtatacaacatatttctcttataaatatcccttggggtgtccaaaaaataacactaaaaaaacacatacacttctatatagttagtttgatgctatgattcctagcaagctggtcctttaggaggcatgtgagatacagtcttaggactggagagaacctaaattcatagttttttagactgagtggatcatagtttactcactcatctgctatgggtctataaaatccatgctaactgaaaaatttttcttagaactctacattaaaaagtaactcattcttttgtgcattccttatatattaaaatccttgcatagcccagaatttacatacataagtattataaatgagttcatcctttttacaaagaagttgattcttttcctttagcctctcaagtgtctctagagcctgcaagactcagaaactctgcttctttccttttcagtcttcctcaatttttttcacttccacctctctccctcatcttatttctcagctacccttcatttatttgattaagaatgtatgactaatcttatagacttttgtactacttaaaagatttttgttcattagtttatttttctggtttaaaatctcatcagggaaagtctttttaattagcttggggagaaatggaaaaaatatcagaatctacagaaactatttttttgaactataggaatgttaattgcagcattatttataatagccaagatgtggaagcaacctaagtgccgtagatgggtgagtgaataaagatgtaatgtaggcaggagaggaaggtggtgacagactaggaggaccccaggctcatcttgtcccacaaatacaactagataactatcaaatcatcctaactaatcctgagaaatcaacccgaagactgatagaacaaaccccacaactaaagggagagaagaggccacatcaaagaacataggaaatgctgagatatgttttagaggagaaatagatcctagatgctatggaaaggaagaagctgtggtctggagaaggatgagagaggagcatgtaggagagcacataaggagagcacctccccaaatcccttgggttggaaaacaagaggggctgaatttcatgagttcttgcaaccaacaaggcttaaaatctggagttttaaagatcagtgggcttggttgggatggagccagagggtactactgtgctcttcctggaaagaaggaaggcaaacaacctggggacagacagcatggaaacagtgatctgaaaaatgcctggagggaatacagaggggagattattgactatttcaagaggactttccaagggcaaaggagctggctggtgccattcccctctcctgatcctcagcataaacacagagccacttatgggaggaagcatcaacactggctgcctaacttgctcataccaagttccacacacctgagctctggcaggactgcccttctgagttagtcaagtctgcctcagacccattgtggcagacccctcccgtagaagatcagtacaaactcctgcccacaccatgtgtccctaccagagttcaaaagggactcagttctggtggaattggtgtcaggtttcgttatttcataagcagaccagaatgcacctagttaaaacttaccacgttcaagtgagggaacaaacactgttcacagcaggtaaggagagcctctgtagatggctgacctaaaagatagagcagccaacatacaaaagcaggacacacacagcacacaccagagacattagctgaagcaacaaggccctggacactacatgacttcttcttaataagaccaatgctttcagtagcaagatacataagtggcttttgtaacacaaagacttagacaaaatgccaagacagaaagacagaagaatttatcctaaataaaagaacaaggtaaggccatggccagagatctaagcaaaactgatataagtaacatgtctgaaggagaatttaaagtaatagtcataaagatgcttactgggcttgagaaaagaatagaatacatcagggagacttgtaacacagagatgaaagagtaaaaaaaaatcagagatgaatactgcaatacatgagactagaaacaggcatgatgcaattcacagaaggatagtagaaaaaggagaatgcattagtgacctagaagacaaaataatgggaaacaaggaagctgaatgaaggaaaggaagaagaattatgcaaaatgaggttagatttagcgagttcgatgactccatcaaatataataacttttgtatcttaggagtcttggaagaagaaaaagaaaagagtgcagaagttttatttcaaaaaataatagaaaatttccctaatttggggaaggaaatagacatccagatccaggaggcacagagaactcctatcaaaatcaacaaagcaggaccaattccaggatatattttaattaaatttgaaaatatagtgataaagaaaaaaatcttaaaagcagcaagacaaaataagttcttagcttacaaggagaaacccatgaggctagctagagatttctcagcagaaacttggcgagtcagaagagaggaacatgatatattcaaagtgctgaatgggaaaaatctttggcctagaatactctatccatcatggctattattcagatagaaaagataaagactttcccagacgaataaacactataggattaaatcaatcctgcaagaaatattaaagggggatctttgagtgcaaaagtgagatcaaaagtgacaaagacaagaaaggatcacagaaaatcttcagaacaactgcaaagcaagtaataaaatggcattaagtacataactatcaataattacttcgaatgtaagtggactacacacacccacatagggtgacagaatggataaaacaaacaagatccaccgatgtactgcctataagagactcactttggacctaatgacatcagcagattcatataaggaggtggataaacatgtatcccataaatggatgtcaagagaaagctagagtagcaatacttctgacaaattagactttaaaacacactccaaaaagagattttaaaaaaggcattacataataataaatggaacaaaccaagaagaaaatctaacaatcgtaaatattgaagcccccaaattgggagcatccaaatgtataaaacaataataataaacataaaggaacacattgataactacagaataatagtaggggactttaaaaccactctcacatcaatggatagatctcctaaacagaaaagcaacagttaagtaatgactaaatgacacactggaacagatggatagaacatatattgaatatattaatatattatatataatataattatatttaactacataattatataatatattaatatattttgaaaatactccatccagaaacagcaagtgcacatagaaaattctccagaatagatcacatactaggtcacaaaacaggcctcaacaatacaaaaatattgaaatcataccacatatgtattttgaccacaatgctatgaaactagaattcaaccacaagaaaaaatcttgaaagatcaaatacataacctaactttacacctttactaaaggagctgaaaaagaaagataaacaaaaacaaaagccagtagaaggaaggaaataatgaatattagagcagaaataaatgatacagaatggacaacaacaaaaccaccatagaacagatcaatgaaaccaggagctggttctttgaagaagttaaaaaaaattgataaattcctagccatgcttatgaaaaagaagaaagaaaaggcccaaataaatgaaatcacaaaaaagagagtataaataacaacaaataccacagaaatacaaacaattatgagaatattatgaaaaactatatgccagcaatttggatgacctagaagaaatagataagttcctagaaagatataaactgccaaaactgaaataggaaaaaatataaaacttgaacaaacaagcaaaaaagttgaatacctaatcaaaaaacacccaataaacaaaaatccaggaccagatggtttcataggcaaattctgccaaacatttaaagaagcattaatatctattcttctcaaactgttacaaaaaattagaaaaggaaagaaaacttccaaatttattcaatgaggccagcattcccctgagaccaagaccagataaagactttgctaagaaagagcactaaaggccaatatccctgatgaatatgaaagcaaaagttctcaacaaaatactagaaaacagagtcaacaatacattaaaaatttcattctccacgatcaagtgagatttattcctgcgttgcaagggcagttcaatatttgcaagtgagtcaacctgatcatcacattggtgaaacaaatgataagaaccatatgatcctttcaataggtgcagaaaaagcatttgactaagtacaacattcattcatgataaaaaccctcaacaaagtaggtttagagggaatatacctcaatataataaaagccatctatggaaaacccacagtgaacatcactctcaatggaaaaaaactgagagctttcctctgacaggagcaagacagagatgtcaccactattatttcacatagtactggaagtcctacttcagcaatcagacaacaaaaagaaataaaaggcatctgaattggcaaggaagaagtcaaactgttgctatttgcagatgacatgatactccctatagaaaacctgaaagaccaccaaaaaactactagaactgggcagccctggtggctcagtggtttagcgccgccttcagcccagggcctgatcctggagacccgggatcaagtcccacgtcgggctcccgccatggagcctgcttatccctctgcctctgtctctgtctctctgtgtctctgtctctctctctctctctgtcatgaataaatgaataaagtcttaaaaaaaactactagaactgataaatgaattcaataaagttccaggataaaaaatcaatgtacaaaaatctgttgcatttctccacaccaataagaaagcagtagaaagagaaattaagaaataaatcccatttaagttatattacagaggtagtgatgaaaacagtatggcattggcacaaaaataaatatatagaacaatggaacagaatagaaaacccaggatagaaaacccaggaatgaactcacaaatatatagtcaattaatttcaaaaagaaggaaagaatgtttaatgagaaaaagtctctttaacaaatggtgttggaaaaaaaatggtgttgggaaaactggacagcaacatgcaaaagaaggaaactgaaccactttcttacaacaaacacctaaataaatgaaaaatgacagaaccaaaaggcaactcccagaatgggagaagatttttgcaaatgacatatctaaaaagtgctagtatccaaaatttgtaaagaatttagaaaactcaacaaccccaaactatccaatttaaaaatgagtaaaataataatccaacttaaaataatccaatttaaaaaatgagtaggatatatgaatagacatttccccaaagaaaatatacagacagccaacagacagttaacagttaaaaaggtactcaacattactcatcatcaaggaattacaaatcaaaactatgatgagatatcacctcacacctgtcagaatggctaaaatcaacaatacacgcaacaacatgtgttggcaaggatgtggaaaggagaacacttttgtactgttggtggggacataaactggtgcagctcctctggaaaacagtatggaagttcctcagaaatttaaaaatagaactaccctatggtccagcaatagtactaccagatatttacccaaagaatacaaaaatattaattcaaagggatacattatatatataaatatatataatattaagtctttgaaaagaatgaaaccttgccattttcaaggacacggatggagcaagagagtattatgcaaagagaaataagtcagagaaagaaatttatcatatgatttcactcacatgcagcatttaagaaacaaaacaaatgaacaaaggaaaaaaaaaagagagagaggcaaaccaagaaacagattcttaactataaaggatgttggttaccagagggcaggtgggtggggtgatgggtgaaataggttgatggagattaaggagtgccttgctgtgatgagcacctgctgttgtagggaagtgttgaatcagtatatggtatacctgaaactaatattacactgtatgttaactaactggaatttaaataaacacccatcctgggaggttccagaagacctatctttcaccagtactttgaaaaataaatttttttttattggtgttcaatttaccaacatacagaataacccccagtgcccgtcacccaatcagaaaaatacattttcaaggggagctccagctaaaaaaagaaatgtggtatatatatacacacacacatagaggaatactattcggccataaaaaaaggaaatcttgcatacacaacagcatggatggactttcagggcattatgctcaatgaaataagtcagagaaagacaatgtgtgatctcacttatatgaggaatctggacaaacaaaatactgaactcttggatacagagaacatactgtggttggcagagttagggaggggagagggtaaaatgggtaaaaatgattaaaaagcacaaacctctaggtataaaataaaaaagtgatgaggatataatatacagaatggtgactacagttaattatattatgtggtagggtccctgggtggctcagttggttcggtgttggactcctgatctcagctcaggtcatgacctcagggttgtgagattgagccctgtgttgggttacatgctgggtgtggagcctgcttaagattctccccccgcccttcactttctctctccaaaaaaaaaaaaaaaaaaaaaaaaaataaataaataaataaaaatgatgctctatggtatatttgaaagaactaagaaagtaggtcttagcagttttcatcacaaggaaaaaaaatgaccactctgtatgctgatcaatgttaacgatacatattatggtgatcatttcaaaaatgtatacaaatatcaaatcattatatggtatacttaaaaccaataccatgttgcatattaattatatctaagttaaaaaaacactcgagccataaattccagactattatttaagctaaaagacataataattcaagaaaagaaaaacacttaccaattggttcagcaaatcctgattgagaaaattattgtcagttttaattataatgtcatttattatcagattaacaaacaattattctatggctatctggactatgtttgagattatggccatagatacatagttggtaaatatattttcagaaattattttcttttcctttgttttatattcttagaaattcccaaaatggagttttgggctaaaatacattcataatcaattacttttggaaacttgttacttatctttatttttatttatttatttatttatttatttatttattttatttttataataaatttattttttattggtgttcaattttgttacttatctttaaatctagaagtaactaaatctagaaacgtacatgaaaaaacttttttttttctatagcatcttcaatttgtttatgctcatggaatacacattaagaaatacatcatagtagttaaaactggaattcatttaatgacttttgaggcttaaacattttctgaatgttaagtttgacttttggattaattaactgtacatgttcttctaccatttgccaatagaaaagctgctgacctataaaaaatgtcacaaacatttttggtaggtcaaacttgcaataataatatttactgtatcatttctacatagttgatgttgttggtgtccttgttgttttctaagggaagacctggatggttgggggtaggatctccttactctgatagaagaacaaagcaaatgatctttctggagcttattaaactcttatgttattgccttttgcaatcagtttataccatttttgaaccaatcaaggagttatacctcttaatctcctttcttattacacttttattaacttttcccatctctttgcttatgcttatgaatatcacattggattcagattaaagactggtttgataatggtattttggttagtgagtataatgtattaatttttgattcttaatctttcatcaattatttatctatatcacaaagagagaaattgtagagatatattagcattgaggttttaaaccactaacactatgatagcaatagggagcaaaattagcttacattctatggattttaggatttcaaaaggaacttactaatggatgatgtaggttctttaaaacagaaggaaaaataagacatgagtaatgtgaagcatataaaaatatatccagtaaagaaacttctctaggttttgagttagaacaaaattgtcttatgcaatttttagaaggtgcctccaaaaagaaaagtcaagggaatatcagtacagttgaaactatttgtgtttaatgaaagatcattttaatacctgattaatcctggatattttaatgtttggcttgaaggacctctattgagacaggtttttttgtgtactatatctttcttatccagggcaaagagattttcaaatcttttaggaaggtggtatgatattacagtagtatctatcactctacttttctttcaaaactcaactcttgtcttctttacagtttccttctacattttgttttgaaaaggatttttatttattttgtgatagtcctataataaatgcttttaagctttcctccaaattgtcagtaatctctaaaaaaaggctcactaatatgaggggaacacagaaagtgaaataataacattgagatttgcaaatttgattacggctatggctggacttgtttatcaaatagatccattatacagcatatttttccagatagtattcacagaaaagtaacttactggaaatgttctgaacagttcctgaaaagcaaaaataaataaagaattatttgacccacaatcataggcctacccaaaatatttatttgtcttatattaaaatctagttttcaaggcatctatgatgacctttgattttggaagttctagcagaaacataggtctatggattattcttgcattcacctcctcctcaattgtctatccttttactgacatttagtgtactgtgtataaagtttatacatctctttagttctttcctcattccccattcctttaattcaatgactgatttcctccttggtcaactgcatttcatttaaaatgttggtatttttttctgtcctagtatggacatttacttattttttttaaagattttatttatttatttgagagagagagagcagagagcacaagtggggaggaggagagaagggcagagagaaagggagaagcagactccctactgagcaggaaacccaacacagagcttgatcccaggactccgagatcatgacttgagctgaaggcagatgcttaacttactgagccacccaggcaccccaaggacatttactttttttttaagtagacaaatcagagttcttgatataacaatacatttctccatttattctttctataaatcaattggcttctattaaaagctaatcactgataactctaaattagcttttgatcttctgaaaatgatgcaaaacttacctctggttgctgaatatctgcctagaataaaacataagcaagtgagtgtggtgtagtttgctaacatgcttgataagaaatttgtttaggcttaaattatcttcaagcagtaaataatatcatgtcatttatgttgattaagttaccacatgcccagtacttatataagagcattatgtgattgaaattatttaatcttcagcagccctatgatgaagattatgtgcatggaaattacccacgatcacacagctaataattagtgcaaccaggagctgtctccaacaatccaggatctagtcctgctttgaaaaactgttttttggtcaatttaacaccattatgtctgagtctttagatgttcttccctcaccccttaatgttttttttttattttttttaaaatttatttattgagagagagaaagagagagagaggcagagacacaggcagagggagaagcaggctccatgcagggagctggatgcgggacttgatcccaggtctccaggatcaaaccccaggctgcaggtggcgctaaaccgctgcgccaccggggctgcccaccccttaatgttatagtccaatttcccttgttttctttagtggtaacctggaactggaatctaggtttgttgtactctagagtcttcatgtaattcaatctcttgatctcttgctttttttttttttttttttggacaggagattcctacaaaaggaattagccatcttaataaattattacatcaatgtagtaagtactttaatagaattgtggataagtgctttaggaacacagagaagttccttcttctcaacttgtctgaaagagttgatatatttggggaattgtttttcatttctttgtttccccccacattttggtaattgttaagccattctcatatggaagagagcctggttataatggaaggatgtttctttaacagaggacagggaggggatacagcatggtacaatgggaagagcattggtagatgcattaaaggaaaaaagaaaggtaaaagtaatgaaagaaattgtagaagaatattttcatgaagttgtggttgggtaaaaaccaaaccacaatgtgaaaaattgatatatttgattgaatcaagttttagagtttttgttcaatagaacacataataaatggattttagagataatgacagactaggagaagatatttgcaatatttaaaatctggaaaaaaattgagatgtataagtggcacctgaaaaccaatggaaaaaagacaaaaaatccaatagaaaagtggtaagtgacatgaattaaagctcacaaaaaaggaaaactgaatgattaacaattatgtgatgaagtgctaatgcccattgggactagaaatgtataaattaaagccacattgatatactcttccttcatctgaatgcaaagtttgcaagtggtatggtagatattggtagaaatgtgggttgacagtcatggatggcaggtgggaatagaaattgtatagtgattgtggaaattatctggcatatgctttatgagctagaaatccctttccttgatatagatctcaaggaattcaaacttaagtccagaagggatcacttatcacaatgtccaattacagtgtctttgtgacattagtgaattggatattatgatgtgtctaccatcaggggaatggaattgtaggagaggcattttctgcaatactttacagaattagaagcaacatgtgggatgtatatatagcaatatggacagatctttagaggtattaaatgcaaaaaaggagaagagtaagatgtagttgatgaaattaaacaaacacaaatcaatgttacaggttatttagggttatttttttaaatttttttatttatttatgataggcacacagtgagagagacaggcagagacagaggcagagggagaagcaggctccatgcaccgggagcccgacgtgggattcgatcccggatctccagaatcgcgccctgggccaaaggcaggcgctaaaccgctgagccacccagggatcccggttatttagggttataagaatagttaaggacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctatagtcagggagctagctcttcagtctgcgagatatctctgcctctctctctgtgtctctcatgaataaatagttttttttttaaagaaggcgctagataatcctttaatagagagataaaataacccatctagaatagctgaaattaaaaacgctataaccaagatacagtcccaagtggaggctataaaaatgaggatgaatgaaggagaagaaaaaaactatggaaaataatgaatctgaaagaaagagggaaagaaaactattaggccatgaaggtaaacttaggaaattcagtgattctataaataaaataatatcgatatcacaggagtaccagatgaagagcaggaaaaaagggcagaaggtatatttgaacaagttatatttgagaacttccctaatctgtggaaagaaacaggaatttaagtccaggaggcacagagaactccctcaaaatcaacaaaaatgggccaacatcaggacgtatcatagagaaacatgaaaattacaaagataaagaaggaattccaaaagcaggttgggagggtagacacttaaggctggccttttatgtggaagatatgtccacagagacctggaaggttagaaaggactggtaggatatattcagtgtgctaaatggaaaaattatggattcaagaatacttcatccaacaaagatgtcattaagaagagagggagagagaaagtgtttccaagacaaacaaaaactaaaggaattagtgaacactaaaccagccctacaagaaatattaaaggggatacttcgaggaaagagagagttgaaatgtaacaaagaccagacagagacaatatacagaaactgtgactttacaggtaatgcagtggcacttatccatatcttttactaattactctcagtgtaaatggatgaaatgctccaatcaaaagacagagggtatcagaatggattaaaataaaaaacaagacccattgatatgctgcttacaaaagactcattttagacccaagataattccagattgaaagtgagggagtggagaagaatttaccatactaatggacatcataagaaagctggagtagcaatccttatatcagacaaactagattttagatcaaaaactgtaataagagatgaagaaggacattatatcataataaaggggtctatccaacaagaagatctaacagttataaatacttatgcccctaatttggcagcagccaattatataaatcaattaataacaaacttaaagaaactcattgatgatagcacaacaatcgtagggatgttaacaccccactcacagcaatagacatatcatctaagcagaagaaggaaacaagggctttgaatgacacactggaccagactgccttaaaagatatattcagagaattttatcctaaagcagcagaatattccttttgagtgcacttggaacattctccagaatagatcacatatgtcacaaattagtactcaactggtacaaaaatactgagatcataccatacacattttcagactataatgctttaaagcttgaagtcaatcacaagagaaaatttggaaggacatggaggttacagaatacatggaggtcaaagaataacttaccaaagaatgaagaggtcaaccaggaaattaaagaagaattttaaaaaatacatggaaacaaatgaaaattaaaacatgacagttcagaactattgggatgcagcaaaggcagtcctaacagagaagaacatagcattgcaggccttcttcaagaaacaagaaaagtctcaaatacacaaccatagcttacacctaaaggaactggaaagagaacagcaaataaagcctaaacccacaaggagaaagtaaataataaatattagagcaggagtcaatgatacagaaatgaaaaacaacaacaacaaacagtagaacagatcaacaaaactaggagctagtcctttgaaagaattaatagattaataaacccctagtcgggtgtatgataaagaaaacaggacacacatatataaaatcatgaatgaaagaggagagatcgcaatcaataccaaaggaatacaaaaaattataagagaatattgtgaaattgaactccaataaaaaaagaaaaaaaagaaaaaaaatattgtgagaaattatatgctaacaaattaggcaatctggaagaaatagatgcattcctggaaacttataaactaaactgaaacataaagaaatagaaaatctgaacaaacccataaacagcaaagaaattgaagcaataataaaaaatctcccaacaaataggagtcgctggatggcatcccagcagaattctaccaaacttagaaaaattaacatctactttttgaaaactgttccaaaaaatagaaatggaatgaaaacttccaagctcattctatgaagccagcatcaccttgattcacagttcactaaaaagaagaattacagaccaatatcctttatgaacatggatgtaaaaattctcaccaagagtgagctaatacaatataacagattattcaacattgtcatgtgggatttattcctgggctgcgagcgtggttcaaaatctaaaaatcaatcaatgtgatatactacgttaataaaagacaagacaagaaccataagagcttctcaatagatgcagaaaaagcatttgacaaaatacagcatcctttcttgataaaaactttctgcagtgtagggatacaatgaacatacctcattatcataaatgccatatagaaaagacccacagtgaagatcatcctcaatggggaaaaacgggagcttttcccataagatcaggaacgtgacagggatgtccgctctcaccactgctattcaacatagtactggaattcctagcctcagccattggaaaacaaaaagaaatgaaaggcatccaaatcagcagagaagaagtcaaattttcactcttcacagatgacatgaaactctatgtagaaaatataaaagacttcaccccaaaaatgctagaactcactcagcaaagtggtagaattaaaatcaatgcacaaaagtatgttgcaattctatacatcaacaatgaagaagccaaaagagaaataaaggaattgatcccatttataattgcaccaaaaaccataagatacctaggaataaatgtaaccaaagaggtaagagatctgtacccttaaaactataaaaaaaaggaaactatatgtaaaaaatttaggaaaacacaaagaaatgaaaaacattccacactcatgaattggaagaacaaatatcacaaaaatatctatactaatcaaagcaatatacacattcaatgcaatatagatagatagataaatagatagatagatatagatatctagtagtgcaattgctaggtcatattagagctctatttttaactttttgaggaaccttcatactgctttccagaatggctgcaccagtttgcatcctcatcaaaagtgtaagagggttcccctttctccatatcctttctaacatctgttatttcctgagttgttaattttagccattctgaccagtgtgaggtggtatctcattgtggttttgatttgtatttccctgatactaagtgacattgagcattttgtcatgtatctgttggccatttgtatgtcatctttggagaaatgtctttcatgtcttcttcccattgcttttttttttaaattttttaaaaaatttatttatgatagtcaacacacacacagagagagagagagagagagaggcagagacacaggcagagggagaagcaggctccatgcaccaggagcccaacatgggactcgatcccgcgtctccaggattgcgccctgggccaaaggcaggcgccaaatcgctgcgccacccagggatcccttcttcccatttcttgactgaattatttattttttggatgttgagtttgttaagttctttgtagattttggatactagccctttctctgataagatatttgcaaatatctccccccaattctgtaggttgccttttagttttgttgatttttttcctttgctgtgcagaagctttttatcttgatgacccaccgcatttattcacatttttctttcttgtcaggatcacttttaacattctttgggttttatatctgtttttcttttcttttctttttttttttaagattctatttatttatttgagagagagtgagagagaaaacacagagggagaggcagaaggacaagtagcctccctgctgattgcagagcccaatgtgtggcttaatcctaggaccctgagatcatgacctgagccaagtcagatacttaactgagccactccgctgccctacatctgcttttctaaataacatgtttatagagcttcttcttgacttccatcttaattttttacttcttaccaggcttgaaaaatttttaaaaatgttttatttatttattcatgagagacacacacagagaggcagagacacaggcagagggagaagaggctccatgccggaagccggatgtgggactcgatcgcaggactccgagatcacaccgctgagccacccaggcgtcccccagtcttgaaatttaaaaaaaaaaaaattaactgcggcatagttaacatagagtgttgtattagtttcaggtgtagaatatagtgattcaacaattctctacaatactcagtggttatcacaataaatgtacttttaatccccttctatttcacccattccttcactcatcttccttctggtaaccatcagtttgtcctctatggttaagagtttgtttcttgatttgtctttttttccttcgttcatttgtttcttaaattccacatatgagtgaaatcatatggtatttgcctttctctgactttcttcacttagcattatagtccctagatccatccgtgttgttgcaatggcaagagttcattcttttttatggcggagtaatagtcattgtatctatataccatatcttctttatccatttatctattgatagacacttcttccataattaggctattgtaaataatgctgccctaagcataggggtgcatgtatctttttgaatttgaattagtgtttttgtattcttttcttaccaagcttttttatctcactgtctcccccttctctcatcataagcattccttcatctgatcctcccagtatagtttgttccaatttttatggaaattcattcattcagtgattgatatgttgttacaacccaacttgcctccacagctaaggcatatgctgtgctgtggttatattgtgcttaatgtacaactctttgtatttcctgtacttaatcttttccttttttttcctaaacagattgcttagctggtcctttagatttatgccattttagggccttggttactactttctgtgctctggagtgcatgaaatgagtgtaattgaactgttacctcctcctgaagctctctttaataattttctcacaggtggttttgcaattagagagaataaaagcctgagtgaagcaaaagaagcctttcacatcagtaggagactaaagtacaacagagatgaaacttgaaaaaggaactgagtaatggatcatggggtcttaactactgtgcaaacataaataaaggcccacgtgtagtttgcttgaagggagattattctattcttctcaagaattctttccagggtaatttttaaaatcagaaataataattggagcaaaataatttttaaacaactaggagaccaatttagatatgagaaacagaaaaggaacttatgagtaattctttagttttaactgaaatacaaatacaaataagagaaataaatgtcattctatggagaggagaatacaagtctcttaatagtatgttttcagcaaaatgcaaaatttacattaatatttaaaatagattttttaataatacatgtgtttgtatatcttctaaaaattaaaagttttattggcttattatgaaattagcctcttggcttactcctttctcctttaaacccccaattccctcctcttagagacaaacacttccaaatcttttagatgttttgtttttttggtgtcatttttgtttttttttttacttaaaattcttaaaatgttattttttcaaattacatactatttattgatttactattatgcatgatgtggctttaaccttactctgcttctcctctctttttcttctggtgtcatctagtcacaaattttggttaactcaatagtcagtgttactgttattttatctatgtgaatactcttcactcttcagccaaaagtatattttgatcacgttgtctttattttttagtaatttttaaaaatttggtgaagttaatctctgcctctctctgtttgtctctctctctttttttactgtacttagtttatctgtgtgaacttatgccccatgttatccttctactttaattttagtggtatttcaggggagatgagaggaaaatatatatgattagactgctaagttaaacctgaataccactttaatgccttttcagttctgtgactgaagttgataagaatcagagttcaaaattcaaatgtacaagtctacagaatatcacagataaggaatatttgggtaggttctaaactaaaatataaacaagtaaacacaatattgtgattttcccaagcatagaatgtagttttctctaatgataatttatggtaaaaattatgaagtacagtataaaattcacctgatttcaaaattatttaacttttatttctgtgatagtgacaaatgtaaaaggttgtattcaattaactttacagacctagagcaacaacaacaaaatccaatttttccccattcgtctgtaagtttaattctgtgtgggcaaagagaagcactttaatttttttaaaatgtgttttgcagcatatatctcatataattctatctttaataaatttttgtattaaagtataaatacagggagaatagtaccccaatcagaagtatgtccatcaatgaagtattccaatgtgaacatacccatttaacctccacccatatttagaaataaaacattaacagtaactcaactctcctcgggcaccttcaaatcaatgactccactctccttcccctaaaagtaataattagtctgacttctaaaaccccaagtcttgaactttatacgaatgcaattttggagcgtcttttccccttagttctagcatctttcatttgacattaggttaatgagattctcctgttatttctttttagtacagtttattttcatcgtgtatagcattccactctatgaatatactgtaaatcctttatcccttctactgttgatggacatatgggttatttttagtacttgactattatgaataatgctgcttcgatcatttttgcccatttatcttggtgtgcaatgtgtttacctacaaactttgggtaaatctaggagtaaaatttcctggtcatagagtggtttaactttagtatataatatcaaactttctatttcaaaataaatacaccaatttaacatacattagtagtagtttctactgttccccattctcaccaacattggaagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcacatacactgtttgtccttctccattgacttatttcactcagcataataccctccagttccacccacgtcaaagcaaatggtgggtatttatagtttctaatggctgagcaatattccattgtatacatagaccacatcttctttatccattcatctttcgatggacaccgcggctccttccacagtgtcgctattgtccctttttgtaaagtacattttcaacaactctcttggtggtttttctattgagttatttatctttttcatactgatttataggatcctgtgtgttgtggataaggctcttttttgggtgtatgagatacattttttctccaaaactgtgtcttgccctttcactgtggaaatgttgttttgttttgtttttttgatgaacaacgttcttaattttaatgtataccaacattactttttagggttacttcttcttgtctcctactcaagagaaccttttctttaaggttttattcatttattcaagatagacacacagagagaggcagagacataggcagagggagaagcaggctccctgcagggaacttgatgtgggacttgatctcaggaccctagaatcacaacctgagccaaaggcagatgctcatccactgagccacccaggtgcccccctgctcaagaaatctttacctaactaaggtcaccaagatattctcctatgtaatccttctgtaagtatttttgtttcacttttcacatttagagctaaaactggctagaattgattttgtgtacaattttacttacagagtgagtgatcatcttagtttgcctggcactcagaggaattcctaggatgtagaagtttcagtgctaaaactagaaaagttctgagcaaatgagattatattaattaggggtcaagttttattttccatatcgttattaaatcgatccaatactatttattgaaaaaaagactccttgcctcgatactatgcagtaacaccttattcataaataagtttccagatattcacgaattgtttctcaatcccctactttcttcttctaaaccatttgtctgttttcattccaatagtagtctgttttaattacagtggcttcataatgagacagtctaagttttcctgcttgttcttctgtaagagtgtcttgtactccatgattctttgcttcccactccccctcctttttaataagtatgttttagaatctgtcatttgtgatcaaaacaaaactttggcttttgattacattgaatctacagcttaagttctgaaggattatcattttaacaatactgagttttccagttgatgaatatgacctatttatttgtcttctttaatttctctctctttttaaagatttatttatttatttgatagagagtgagtaagccaggggaggaatagagggagacagaaaggaaaagagaatctctagtggactccctgctgagtgcagagcccaaaacaggcctcagtctatcatgatctgagctgaaaccaagagtctgccgctccacaactgagccacccaaggagaaccagtgttgtagttttctatgtagaaaacttgcacatcttttattaggtttatttcttggtatttatccctttgatgctgctatacatggtaatgtttcttaaattttcattttctaatttttctttatgtgtatagttgtgcataataactgcatttagtaacattgttaaattctcttaataattctaacaatttatctttggagtcttttggatttcttgtatgcgtaatcatatcatctgaaaaaaatgagtttttttctttcaaatggcaatgccttttatttcatttaaaaataaaatcttattgaatggcccagacctccagttctactttattagaagagataatactggccatccttgtatttttcttttatttctaagaagaacttacatatttaaaacttaaaatatgagatttcctgaaatatttttaaacagacttttcagatttaggaagctctctttctagtttgttaaaaagtttttttttttcttaaatctgtgctgtattcgtttctattacttctgtaactaaatgccacaaatttagtggttaaacaacacagatgtattatcttatagttctggaggtctgactccaaaatcagactgagtgcaccacagttgcagtgttggcatggctgtgttccttctggaggctcaaggggagaatctgttttcttgtttccttcagcatctagaggctgctggcattctttgcctctttgccccttcctttatgttcaaagtgcatcattccaaccactagatatctctcctctgactctgagaggccaacctggataactaggtaggccaacctggataactcaggctaatcttttcctctcaagatcccaaaccgaatcacatctgtaaagtcctttttgccatataaactaccatatggattccagggatcaggatatggaaatgtttggggcaagggggagcatcattctatctaacataggtggtgaatcacattgactgatattttatataaagcaattttggatattgaaataaatctaatctggttgtgacaatgtgacagaaaatatactttgtaatttttgctctttgaaaattgttaaagcttgatctatgacttagaatgtggtcaatttttaaaaacattctgtttacatttgaaaattatacatctgctattgtacaatgtaggattctatattcccttatggtatcgatttttatttatttatttattcatgagagacagacagagagagagggagagaggcagaaacacaggcagagggagaagcaggctccacacagggagcccgacgtgggactcgatcccaggtctccaggatcaggccctgggctgaaggcagtgctaaactgctgagccacccgggctgcccctcctttatggtatcaaatttgttaatcattttaaagcttttatattctgtgtgtgcctgtgtgtacttactaactagtgacggtgaaaaatttaaaactaaatgattatagattgctctcttttcatgctttcatagtttgttttatctatatttgaggctatgttattatatatataattgagccttgaacaacctaggtttgaattgcatgagtccacttatacatagatttttttctctttgctttattgttaaaaatatttaattttctaaaagatcacacaaaagctgggaagagaaagaaggaggtcaactagcctacattaaaatctgggctgaggaaggacaaagagctacctaaggaaactgatatctggagcaaactctagagcttgaaatggctgcatgccagggggaccagcagcctgggtcagtcacactgatgagcaccagcagggtgcagtgggcacatcaaagttgctgcaccaattattcctccttttcagtaagggaaagcaggagttcagtgtttagatatgatcttgatggtcttcgggccctttctggtcttcttccagttgctaccattgaattcctcaatgaccacactccaggtgatgccctcaatttcagcatgtgaggtattgaaaagcctccagggtctgagtggtgagtggaaaagctctgaacatcccatctcttacacagaaggtgtgctgtgctttctgtgttgactatgtatgtagttactctctgggctcccttcagaagctggaacaatgaagtatgtatcttcttgaaaattctgcagttgagtcaaagatgtgcagttgtggtgaggccacaatttgagaggactgctccaccatggtgtgctctacggggccctggtaatgcaacgtgtccagccacagcttggtggccccctccgaggtgagcttctgcatttctggagcctgtcccagtgctctccctggcagtggaagcccagcgtggctaccaaggtcttggggaccgcggtggaggatccccctgaacagtctcctcctggggccccagcatgtgcgcctctgcggcctcctgcccactatggcttcctctgctccctggactggctctgcctgggcctagcaggtcggttactgtaggcggccaggccagcagggacccccccgaagttgcggttctgctcccagcctgccagggctctattcctggatttttccggtagactgttgtaaatgtttttctcttccttatggtttacttaataacgttttcttttctctagcctactgtattgtaagaatatagtatataatatgtataatatacagaatatgtgtttaattgtatgatatcgatgaggcttcaggtcaacaggctactaagtttttagggaatcaaaagttatagccagagtttctgctgcgcagggtctgtgatcgtttaagggcacctgttacacaagtttagaattgctgtatttatctggccaattgaacctactcgcattatgtgatcttaatcgctaataatgctttttgccttagattcctgcaatagatatatcggtaaccattctctttaggttagagtttctgtggtgttttttcatcttttaattttccaatcttttgctgtcttcatattttagatttgtcacttgtaagtgtatatatgggtattattttatatttttatttatctagtcagattatcctagtcttttaaatggaagcagttgatccatttgtaattcaaggaatttatgatataaatgagtttaatatcatcttgctgtgctttccccatagtacctataatacttctctgtccttccccagctcatttccctccttcccttcctggctaattcttcacttctttcttctcctcttcttttatgatggtggacttttaattttttcatgttctgcttctttagcttggtattttatattactgtagcattttactagttctttatagagaataaaaattgtaaccttgttttatcaaagtttaataaaaatagtatttttacttgcatgtataaaacaagtaaactttatttatccctgtctctactttatgttattactctcatttattttaaatatacacaaatgaacatcagcatctaagttaaaaaccttcaggatgttattgttttgcagtcagtagttattaagattatctatgtatttatattttcaggtttgatattccttacagcatttttgagactttcatctaggatatttagtaggaatctttcaattaatttacctttttttttttttgcctgaaattgctttttatttcaccttcatattaacaatattttgtttttttatggaattgagcccaactcagggttttatcccagggccctgaggtcatgacctgagctgaaatcaagagttggctgcttaactgactgagccacccaggagccccaacagtgatttttaaatccgtggtattatatctttctggtatgaaagggaaatcccttgttgcaatattctttgtttcctattctttctcttttcttgttctgggatactaatcatgcagatgtttgacttttttctctgtaactggtattactctgatacgctttttttttattctgcatacttttgtctccatgtttcattctaaatattttcctttggccctaaattgattctttgaaaaatgtctgacaaagaaatgactgacaagaatgataaaaagatagagaacacacatttcccaatattaagagtgaagaataagacatctcgatagctactacatgatgatgtgtaactttcaattttgaacaagtaaattcacaacatacacttcacttttctcactttgtatatatcacaacttctgctaaaaatcattattctgtgtttacgttattgtgaccagataatactattaaaatgcaaccaatttgtcagtgtggttttacttcatttctttacaaatttttagtattacccggaatttatattgcttttattttttcatttgattttctttgcattaatcactaacatatctccagaattaataagtgaaatatatagtcttttagtttgttgaaacatatctgggcatttgtctagtttcttttcttttagagacatcttccacaaatcccttagtatttcaactggtctagttgattttttttgcagaatggtagtaattttgggatttttatcaataacaagctgggaagatgcaatttgacctgtgtattgaattgcatgtttttgcaaccccgtttggatcctttgaatttctcttcctcggtttacgtctttgtttgcatgaagtacattcacatatttcttcttgataaagaggacttgggagataaaaattttatgatcttgcattcaggaaaatagcatcatttgatcatcatagttgtttgataggattttgggggatacagaattctccattggaattatatccattagaattagaaagcagtggtacattgttttctaatttcagctgttattattcagaaatctgatggtattctgaaccctgaaccctggtatttgtcaacttctctttcttttcttgtgttctgaaaatgcatgatgcatgtgcctttttccacttagtgtgaagagccttggtgtagtctcgattttaacttttatggtaagaaaatctgaatgactgttctctcttcagccccccccccccaaattgttgcttttgatcaaaaactgtttgatttatgactggtagtcttgttaatgtggagtaaatcttcctgaattgtttttttcttttcacttaattcctattttctttgttttgtttggttcagttgactttctaggaattttgttgacaacattttccgaccattgtacagaatattactatttaattccttcaaatttttagtatcttacagctctcttttcccctaatgtgcttttcataccaccctgttaattcataattgtcctgcactcctgttaaagaggagcacatcttttggtaccattactttgttttattcccatcttctgtgttttatttcatttgcctcaatggaagttttgttttattttgttttgttattaaagactatttattaggtaacagattttcagaggcaaacagttttggattgtttttttctcttgacaacaatgctacaaggatttttcagatatatatgttaagaaatctgctccttatccacactgctctttgccttagtagtcacttggaactaaagaaaaacattttccctaaaggagttatcaatcttatactactttctttaatgcaattatatctgctggtccatttctccaatgaatggggacaaacatctagatggaagaaatatgtagggcaaagtaagtgagaaagacacactgttcttccagtgcttcttccttgtgttcaccaacccactggaagcttgctatttatgtattttttaattaaaaaaattttttagttaaaattaattaattaacaaataatgtgttattagtttcagaggtagagtttatttatcagttacatagaacaccgaatgctaattccatcaagtgctctccttaaacccaattaccccatcctccacccacctcccttccagcaaccctcaatttgtttcctaaagttaaatctcttatggtttgtctccctctctgattttgtcttattttattttccctcccttctcctatgttcatctgttttgttccttaaataccatatacgagtgaaatcataagatatttgtctttctctgaccgacttatttcacttagcataataccttctggttccttccacatcattgcaaatggcaagatttcattctttttggtggctgagtatgtatatatatacacacatacaacttcttcattcatccatcgatggacatctgggctttttccatattttgactattgtggacatttctactgtaaacattggggtgcaagtgcccttttgaatgactctgtatcctttagataaatctagataaatctctagtagtgtaattgctgggtcatagggtagctttatttttaacttttgaggaacctccatactgttttccagagtggctgcactagtttacatttccaccaacagtgtcagaaggttcccttttctccacatggtaccaacatctattgtttcctgagttgctcatttcagccattctcactggtgtgaggtggtatctcattatggttttgatttgtatttccctgatgatgagtaacaatgaacattttgccatgtgtctgctggctatttttatgttatctgtggagaaatgtctgttcatgttttctgcccatttcttgattgaattatttgttttttttggtatttaatttgataagttctttatagattttggatattagtcatttatctgataagatatttgcaaatatcttctccattatgtaggttgcctttagttttgttgaccatttctgttcttttgctgtgcaaaagctttttatattgatcaaatcccagtagttatttttacttttgtttctgtttacttttaagatgtttctagcaagtagtggctgtggcccaggtcaaagaggttactgtctatgttttcctctaggattttggtggattcctatctcacttttaggtctttcattattcttcattttattttttgtatggtgtaagaaagtggtccagtttcactcttctgcatatgactatccgattttcccaacagtatttgtggaagagattatcttttttccattggacattctttcctgcttcattaaagattagatgaccatagaattgagagtcaatttctgggttccctgttttgttccattaatctgtatgtctgttcttgtgctagtaccatactgtcttgatgattacagctttgtacagcttgaagtctggaattgtgctgccaccagctttgatgttttctttttttaacattcctttggatattctggttttttttttttctggttccagacaaattttaggattgtttgttccagctttgtgaaaaatattgatggtcttttcaaagggattgcattgaatgtatagattgctttgggtagcatagacattttcacaatatttgttcttccaatccatgaacatggagtgttttaccatttctttgtgtcttactcaatttctttcatgagtgttctatagttttcagagtacagatcctttacttctttgtttaggtttattcctaagtgtctaacagtttttggtgcaattgtaaatgggatcaatttattgatttctatttcttctgcctcattgttagcttatagaaatgcaacagatttctgttcattgattttatatcctgctacattgtttattcatgtatgaattctagcaatttttgggtaaagtcttttggattttcaacatagagcatcatgtcatctgtgaagaatgaaagtttgacttcttctctgccaacttggatgccttttatttctttttgttttccaattgctgaggcaaggacttccactaccgtattgaacagcagtggtgagagtggacatcctcttgtggtcctgatcttaggggaaaagctttcagtttttcccgattgaggatgatcttcatggtgagccttttgtatatggcttttatgatattgaggtatgttcactctatctctacacagcagagagtttttataaagaaaggacattgtattttgtcaaatgctttttctgcatctactgagaggatcttatggttcttgtcttgtcttttattgatgtagtatattacattaattgatttttggatgttgatctacccttgcagcccaggaataaatcccactttgtcatgttgaataatccctttaacatacagttggatcatattagctcacatcttggtgagaatttttacatcatgttcataatggatattggtctataattctcctttttagtggagaatttgtctggttttgggatcaaggtaatgctggcatcaaagaatgagtttggaagttttccttccatctattttttgaaatagtttcagaggagttaggtgtagcaattcttctttaaattctcctgggaagctatctgactctggacttttgtttagagatttctgatgaatacttcaattttctcactagttatgggtctgttaatattttctattcttttttcagtttagtggtttatgtttcttggaatgcatccatttcttccagactgcctaatttgttgacatataatttctcataatattctcttctaattgcatttctttggtgttggttgtgatctgtcctctttcatttatgaattttgtattgggtcttttctcttctttttttggtaagtctggctaacggtttattgatcttattctttcaaagaaccagctcttagttttgtcaatctcttctactgttctttgatttctttgtcattgatttctgttctttttttttatttaaagattttatttatttattcatgatagtcacagagagagagagagagagaggcagagacacaggcagagggagaagcaggctccatgcagggagcccgacgtgggatttgatcccgggtctccaggatcatgccttgggccaaaggcaggcgccaaacctctgcgccacccagggatccagggattccccccattgatttctgttctaatctttattatttctcttctctttctggatttaggctttattttctgttcttctttttccagctcctttaggtgtaagattaggttgtatgtttgagaattgtttttctttttttaaagattttatttatttgagagagggagagagagaaagagagagaaagacaatgaatgagagagcccaagcagagggaacacaagcagggggagcagcagaggcagagggagaagcaggattctgggatcatgacttgagccaaagacagacatttaagcactcaggcaccccgagacttttattgttaattgaggaaggcttgtattgctatactatatccttccctcttaggaccacctttgttgcatcccaaaggttctgaattgttgttttccttttcatttgtttccatgtattttttaaaagttttttttaatttcctggttgacctattcattctttagtaggatattttttaaaccccatgtgtttgtgttccttccaacttatctcttgtgattaagtcaaagtttcaaagcattgtggtctgaaaatatacatagtataatctcaatcttttggtacttgttaagacctgatttgtaaaaaaaaaaaaaaaaaaaagaaaaaaaaaagaaaaaaagaaaaaagacctgatttgtgacacagtatatgatctattctggagaatgttccatgtgcactcaaaaatagtgagtgttctgctgctttaggatgaaatgctctgagtatatctgtgaagttaatctggtccttgttggtcttctgcttagatgatctgtctattgctgtgagtggggtgttaacattctctactattattgtattattatcattgtatttctttaattttgttattaattggtttatagaattggctgttcccaagttagtggcataaatatttataattgtttaatcttcttgtttgatagacctttttattatgatatagtgtcttttttcatctgttacagtctttggtttaaaatctagttagtctgatataagagttgccactccagctttcttgtgatgtccattagcatgataaatggctctctaccccctcactttcaaacttttttttttaaattttattttatttatgataagcacacagtgagagagagagagaggcagagacacagacagagggagaagcaggctccatacaccgggagcccgacgtgggactcgatcccgggtctccaggattgcgccctgggccaaaggcaggcgccaaaccgctgcgctacccagggatccctgccccctcactttcaatatagaagtgtctttgggtctagattagactcctatagatagtaaatggaggactcttgtttgtttgttttttatacaatctgatatcctgtgtcttttgattggagaatttagttcattcagagtaattattgaaagatatgaatttagtgccattttattacctataaaatcactgttccttttttttgtttaaggttttatgtatttattcatgagagacacagagatagaggcagagacataggcagagggagaaacagtctccttcagggggcctgatgtggggctcaatccctggaccccaggatcacaacctgagtcaaaggcagatgctcaaccactgagccacccaggtgaccctaaagtcactgtttctgcagattcctttctagtcttttttacttttcaactttctcttagctcaaaggattccctttaatacctcttgcagggctggattagtgttcacaaatttttttagtttctgtttgtcccagaagctctttatttctccttctattctgcataacagccttgctggataaagtattcctggctgtatatttttcccatttagcaccttgagtatatcatgccagtcctttctggtcagccaggtctctgtggacaggtctggtgccagaaacatgtttctctacccttgtaggttaaggacctcttgttctgagttgctttcaggattttctctttatctctgaaatttgcaagcttcactattgtatgtcaggcttgacctatttttattgattttgatgggggttctctatgcctcctggacttgaatgcatgtgcttccctggattagagaagttctcagctctaatttgttcaaataaaccctttaccctcctgtggcccctattattcagatattttactttatgatattgcggatttctccagttctccctttgtgaataagtagttttctttttctcatcctcgttcttttcatcattttatcttttatatcatgaactctcccttttgcctcgttcatcctagtagagcatccagttttgactgcaactcagtaatagtatttttaatttcagcctgattagattttagtttttatttctatagtaagagattctctactgtcttctattcttttttttcaagcccagctagtatctttattattgttttgaattctagttctgacatcttacttatatccgtattgattaaatccctgtcagtgagtaccacctcctgttctttctttcgaggtgagtttcttcattttgtcattatatccagaagagagtagatgaaagagaaagaaaagacaaaaatagcaacaacaccaccagaaaaatacaaacaaaacaaagcagaagaaaacagaaaaaaacaaattaagaaaaaaaatcagacaagaagtaaaacagaagaaaacaataaactagatccggatatattttggtctttgttaaaagaaactagattgcaaaataggaaagaaagagaaacctatatatatatacaaaaataaaatacaatgaaatgaaacaaaaaataatgtatatatgcattatataatgtatgcattaaaaataaaaattttaagagaactaaaaaaaaattgacagaattgacaatagatgaggggtgcctgagtatctccattggttaagtgtctgctttcagctcaggtcatgatcctagggtcctgggatggaaccgcatggtgggcttcctgttcagtgggaaggttttattcctgggtctgcttttccctttcctctctgctctctctctctctttcgctgtccctctctctcaaataaataaataaaatattaaaaatagaaaagaactgaaaaaaaaaaaaactctgaaggactaaggaataataattaaaaaaagaccacaaatggtatatgctgttttccccaagagctgaaggttttttagttctctatgatctgtaaacttggtattcactggttgttcgtgcggggcttctgggcaaggggcctgttgcactgattcttaggtgtactagccccggtagaatgtgcccccccttgccagggagctgagctcatttatgtggctccaaattgctctatgtggcactattttgctccctgagggctttcagcaccgatggtgggggatgaaaatggcagcaccctgatctctagctttggagctgaaatttcactccccttacttgtcagtgagccctcatagaaaagcagtcaatcaattcttgtctctctggtttctgtcctctttgtttacccagcctgtgaccaagcatttttatctcactcaggcataggagtccagtttccagtctccaaacgttatggactgttgtggtgcccacttgtgccattcctcctaggggaaagaggggagtcttgccacgcttctgccttttgctggatcctgcttgtaaagcggtcactcgaccatgcagcagttcatagtttatggcaacatcaagcagaaagctagcacctaactcgctcttttcagctggcttccctgtcccgatgtttggaaactctgacacacttaggcacccgcctaatcttttagtgaccctagggaacctgaaatcatgctgttctactctttttttaagaagtaagctctttttttaaatagctgtatcatcttatagattattagtatgtcattttcacatattttaaatatcatatctttttcctttaatgtactttatataatctgttgatttatgagtgaattattttatgtatctaaaatacattttaaaaattttacagttttctccaaattttcttggtttccctaatttcctttttactgtatgatggtttaagtctacaatcttggttttgagtgttttgtttttggtcttttggttttgagtctgtcttacaatgtcttatgatacttggaagtccatttatattgaaaaatgaaactaagtaactgatcttatgtgcctaactacaaattaccaccccggctagtcaggtttatctaaatggcctttcatataagaatctgtctgtcttttctctggggtggttcattttctctaaacatgggttatctatactttctgagttttctgaatacattgggggaaaaatgtgggatctaccttcttataattgtccctctgctatcaggtgtcaccctgattttgcctgtataggaaatccctatatctagggttcctttgatctaacctttcctgggcataaaccatttttcttctactctaccatgtgagaccaaagtagatgggtgactaagaggagtggaagagatgatttatgtaaaactgttttaacaaactttcagctaaccatcctgtcttaatatccaccctcacatgcttgtctgaaatgttatctggtacctgaaaatcctgagccttctggttctagtctttacaattagcctcctaaatttccttaggattcatgttttgtgaatagctgaattattgattattcatccatctgctttacagctttaatagttttgtttcaaattttcatctgcttatttctctgctactttttagatactatagttttgcctttgaaaaaatattttctttaaatttaatgtgtttccaagggaaacctcctatttccttttaacttacactctttgggagtcggggttctagaactaatatttagttgtaaaatgtccatatgatatttcatgatttcccaaatttgtataacacacattgtcttccaactatgagcaacaagtatgtaccttatttttatccacttattgttatattagtttcaggtgtgcagtataatgagtcaacaattctatatatttctcagttctaagaagtgtacttttaatcttctttatctatttaacccatccacccacccatctccctcctggtaactaccagttttttctctatatatttaattgtttgtctctatgtggttttttgtttacttgttttgttttaaattcaacatatgagtgaaatcatgatatatgccattctctgactgacttatttcacttagcattatacccttaagatccacccattttgttgcaaatagcaatatttcattattttcatggctgagtaatattcctctgtgtgtgtgtatgtgtgtgtgtgtacactagagctttcttttaagcaactgggttatgtgattgtgtgagctggcttgacaattctgataatttaaaagtaggccagctgttgggactggctggaatacgtaggctcagtctgagattattgtccataggggaatttcttcttcattagggaagcctcagatgtactcttacggcctttcagctgattgaatcaggtccactcaaatcatctactataatctctcttacttagaattaaattatgaacttgaatcacatctacaaaatacttttccagcaacatttgtattcatgtttgaataacatttttttgtttgctttttgattgaaatgcatgaagaacccaaagtcaacagttgatgttctttgcttctagttcagtggaattgttgtgtccttatggaagcattattcttggatccatgacctctagattagcaaagcctaaattcatggtaatggaaaacaaacattttactcgtggatcactaggagtaatagtgagtgaagccaattccatttaattcctggttgtatattggactgtgatttagagtatatataacattctacaggacattgcttcatcaggaccaggtattgtcttctagttggcactgtaactgagttctttaataccttatattcttttaccaagctagctgcattaagataatggggaatatgacagtacaagtgaattctatcagaatgggcccattgctagacttcgtttactgtgaagtgaatttcttaatcagaagctatgctgtgtgttaaccatggtggtggatgagacattttattagtccactgatggtattattctatatggggaagacaaatcatatccacagtaattaactatcccagtaaaaataaagtgctactccttccatggtgtaaatagttcagtgcatttaacaagccagcacttagctggctaatcaccctggagcatggtgctgcattatagactcaatgctgttctctcctactggcaaattgagcagctagcagtggctgtagctaggtggccttgaagagtaaacacccatgttgccgagcacatgcataacctgctaccatgatcactttgcttatggtttcactgggcaaagaaggataactggtatccacagagtggttccctctattttatttaaatccttttctgatgaggttactctggtgatcattcacatgggacagaaatatctttatattattttcctattcagagatatttatccacatccttctttctcagatctctttgttaccaattcctgtgttcatttcaagtccctgatcatccagtcaaacttttggctacagccaatgaatttacatagactttaatatctgactattgcccctttcagacaaaatgagcaatcaggtgtactgcttgaagttctgcccactgaaaggacttcccttcacgttccttcaaggatgtctaagaaaggggcaatagagccattgtgcatgtccaactttatgggctggttgttcagacaacagctggttcatgataggcagctcagatctcatggcaacctggtagccctcggttaagcattcagcttctactaatactcagtagcaatccaaaagctttttctcaaaatgagaataattatttgcagaggatggcagatacttattttaaaatcctaagagcctcccaaaggctccacacagcatttctatctgccactaatacttcaagcacatcatatctactggatcataaggcctaagtggctcagaaacttgcatagaagcttggatctattgcctagccttttcttgttctgactcctactcaaaactagcagtttttcaagtcattctgtaagtgacccaatgcagcatacccaaatgggtatcatgttgcctttgaaatacaaagaggtcccctaggcattatgctttttttttttccattggtaggaggaactagaggcagtaacttattcatcatcatgaaagatatatcttgacatgccccacagatttgcaccccatgaaattttgctgaggtgaaaggctttgcattattagtggaattgttttctacttctgacatactaatatatatttttaaagattttatttatttattcatgagagatacacagagagaggcagagacataggcagagggagaagcaggctccatgcagggagcctgacgtgggactcgatcctgggtctccaggatcacgccccgggctgaaggcgacgctaaacccgctgagccaccggggctgccccatccgtttcatctttagggacaccattattaactagccaaggtcttaggtctctctgtgagtcagactcttctgattcctgctttggctgtcagtcaactctgcttttaaaggccatacaacagattgaatcaggatcaccagattttctaggataaactcttacctaatgccaacctgttacagactttaatcacaaagtacctttacagcaacgcctagattagtgttcaattgaatatctggtactatgtctagcctatgtggcatatcaaaatactatcacaattaggaatccacattttgaccttctgtactaaattgcatgttttgggatttcttcatttcctcttccttggtttatgttctttgttttgatggagtatattctttactttttcctggagaaagaatgcatggaagattaaaattttgagaacttaaatcatacaatttttatatttgcttgatagatttccttggcaggtaatccattggaagtattttagaattaggatgcatttgctccgtttcttagattccatttttgagaaatatgatgacattctgattgttgatcttttgtaagtgtcaatttttcttcattctcagcatattttgaaaataaatgctgtaatttgacatgtgctttttttttcactgttcattgtgcagagcacttagtgagctttttctttttctttttttttcttttaaaaaacactgggttttttcaattttgatctctcatgcttttctctatccttttttcctctcaccattaaaaacagaatcttttgtctggcactcctattattgtacagtacatcatcttgaactattattttaattttctttctattaccattttctgcttttttgtttattttttgcttcattttatcttctaggagtttcttttgacatcatcttcgaaccattttatagaatattaatgccaattgctcatatttttaatattcggtagctcatttttgttctctgaatgtcacttttttatatcaccctgtccttttttcaagagatcagtaacttcttagatgtcttaaacatataaaaaaaatttctttttttctgagttttcttgatttcctgcaattacctgttctctgcataataggttcttcattttcaaggtaaaatctgttctgcaatatctagtgatcactgaagtacactggaagaatttaatactaaatagttgatcatgtgtatatggatagtgattgtcacccaggtcacttggctttctctgtgtaaccttcaatatcagaatctgtaggtctttcttctaggatagttcattttctcctttgcagggtcgtgtactctcatgtatgggtaataaaactgttaaaattctttgagtattttggggaaagaatataagttgcggactattattttgctctctattatcaggaagcttctctgttttttctgtacatggaggccttgtatctaggattcctctgattccaaactgtcctgaggataaagtccttttcttctactctcatatgttgtgtgtacagtggggaagcctgatggaggggaatggaggagatgatgtatatggacttatttaaacaatgtttttagaaattatcttttcctcagccacgtctttacatctctgattgaaatgttacctggtaccacgtaatcctgggtcaatctggcttctgcagtttaggaatagatctcttgaatttactaatggttgatgttttgtatatcatatagaagcttttgtatatcgtatatataagtaataactaacttagcttttagtgtgattaactgtgtttgtactttttaagctttaacatttttgttttaaattttcatctacttatggtttctatcaccttttttagacttttaggttttacctttttaattatttttaaaagattttatttatttatttgagagagagagagagagagaaaatgagcggggggaggggcagagggagaagaagaagcagactctgctgagcagggagtctgaggcagggctcaatcccaggcccttgggatcatgacctgagctgaaggcagatgcttaaccaactgagccacctggatgtgcctaggttttgccttttaaaaatagtttttctttcaatgtggtgtgatttcaagattcttgaaggaaaattaagtttaaaaaatttttatatttaacttcaatttcgcaattatattttttaatgaaggggtttataagactgttattcatgatacctagagaaaaaaatatattttactaagaaaccaaggatactagagatagaggacagaaaaggggcttactggtttgttctgagctattctcagaaaaacaaacacaaacaaatatttggctaaattagagatgagattgccattttctttatttctctaaagtaagaatttaaagaggtagaaatgatgacagctaagtgtaagttatatttaagtttattttaaaaaactgaaaaatatatatgaaatgtatatttcaaatatatatgaaaaatatatatgaaaaatatattaagcttaaaataaacttaaatataacttatttatgagagagagagagagagagagagagaggacaagtgggggagggaggtgcagagggagagggagaaatagactcttcactgagcagggagcctgatgtggcactaaatcctggaactctgggatcatgacctaaggtgaagacagatgcttaacaactaagctactcagaggccctgtaaatgcagttttaataagcatgacaaggaaagcataaataaggagtagcatgttcaagtgttcttatacttcttaaattgtcttattaatttgtaatgttagatgtagtaatttcagagaacctgggtggctcagtcaggaaagcatctgactcttggtttctgctcaagtcataatcttgcagtcatgggattcagtgctgccttggcctctgtgcttaacatggagtctgcttcagattctctctctgtctgcctcctgctcactctttctttctctctcaaataaataaataaatatttaaaaaatatattaatttatattaaagttttataagataaggatgaatattgtcatctctgtgataatccctaaaaaattagtaaaataatgtgtggttaacatgctatgagatgaggaaaatagaattatgaaaaaaattatttcaaaaaaaaaattatttcaaaagaatgcaaaaaagaaaaaagatgtaaaaagatgggggtcatcatcattagcaaactgattagtaatatgatttttaaaaatacgaatacatgagcaattacactagatgcctaaatatttagactatttattacactagatagtttaaatatttctgttatgtgaaagtatttcagactagattaagaaataaaattcaaatatatacatatttttcattcttttttctttttaatgctctgatgagatgaattcaactgccttgtctttgagttgactgatcctttcttctgcttcacctaatctgcttttgaacctctgtagtatattttttttaactcagttatggcattcttcagttttgacactgctgtttgtaacttccatatatttttatttctctgaagttttcatgtattcattcattctcccaaatttgatgagtatctgtatgaccattgctttgaactctttattggataaattacttatctctgtttcattaagtttttttttttccggaggttttatcattttctttcatatggaacatagtcctctttttcttcattttgctttaattttctgtgttggtttctatgcattaaccgcttctcacaatcttgaaggtttgtccttttgtgtaggagattaaccttatcactcaaccttgcttttggttgtctctcaaacttttatgattgtgcaagcagtctatttgactttaatagctctcagtagttgagagcatgccaagaccagttaatgtcccaaagaggaggatgtcagcagtcagcccacctaaattcaggctgattggaagccagatcctcatgcagcaactctgaatttatatatatatatatatatatatatatatatatatatatatatatatacatatatatatattaagactacaagtataagctctcctggcctcagggccaggtggtctggaggtatctcctgggcagcagttgtaaaaatcagtaatctagaggagtgtataagctcccttgtggagataatggtgaggtgtagtgaggcagaaggaaattatagagatggtattctttgcctatgtttctgagagtgcctctgtagcctctagatgtgtgccaaagctgatatcctctcttaagtctgaagttccaggacttggaaatagtcctttttcacagaaaggctgggggtgtgtttcagtatggtccgtacagtacactggaaattatagcctaccaggagctgtctctgaatcttatagtcccatgggacccaggacaacaagctcctttgctcatcaaagccaggtgatcaacaggtatcccctggtcagcagctgcaaaaactagtacaccagatataaaaataggaacactagacttatataagagctccccaccaaaagatgctgttactctgaaggtagtgtatgtcctctgaaatttcaggaaaagtttacagtctgtttaactagaagtctaccactcttgctgtggctattatgataaactaatgatttctttcacagaatgattgagctcctgagtgttgtctgttgctatgctggaagtactagctgtttaagagctctttctccattcaatgtggaacctgtgcacataagccctgctggcccccaagccaagtgatgtagaggtgttccctggcagccacaaaaatctggatgccagagaaggatataggctcttttctgtaaaataccagcgaactggagcaaagcagagggaaagcacaaagattatattcactggcctccattccctgagagcacttcagtaggcccctaaaagtgtgtcaaaccagaactcaggccaaagttcctggacaagcaaataggtctctttctgaggaagactggaggtattatttcattctgctgtctgtgcagtgacttgagagaggtagtctgcctagagctgattctccaatttgggctcatggaacccaggaaagcaagcctccatggtcttcagggccaggcaagcatggggcatcctctggatgccagcagcaaaacctgtcagtagatacagaaaaaacaactgaggtactagtggtgcccattggttagagtgaggccaaaggagggtcaaaaaagaaaaaaaagaaaagaaaaggaaaaaaagagggagaaaaagatggtaaccattgactctagtaagatggaaggagaataggaaaatagtggtaactagtctccatctccagagagtatccagcagtcccatgcacctcagatcaacactgtaaaactagaaaatgagtctctttcacataatgtctgggcacatttcaaagggctgcttctgtctttcctggtgtaggagcaatgagtctgggtgcccttttaaggccattcctcagttggccacatctggtttttgtgggcatgagccccattggtcttgaaagccaggtattttgggggctcatctctcaagtggtgatcttaaaaattgggttggtagggctgatgtgggttatgaatcctttgcctcctggagaagctccaggttgtgggttctttcccaatgatggattactcctcaatgcgtgggaaatatggcagtgttgtgtcttaacctttcctactcactttgatgtggtttccctctggtttaccccatgtgagggggttacttcaccagttctttttttcccctcagaggaaatcattccatacccccccccacacacacagccatagatttagtgtgtctgtcagagaaggtgagttcatgatcttcctatattgctatcttgaatgggaactagtcagataaagatttttaactggacattccaccctgtatttctgccttcaatttatgagcctttcctgaatttcaaattgacattcttttctctactgtttgtacttgtttcttctatcttctctgtcagtaatctgctttcaaaaattttcaacacttacaaattgctctcatatcttttcctcatgttccttgtcctttgtgtatatgctttttccatttctttatttcattccaatggaattttaggcagggagttgaggtaaatgccttgttaaactaacacacattcccactcccccaaccctgaactcattttgaagctcatatttaaatatgatagaatgaaactggtaatatcaccaggagtcagagatcttccagacaattaatactgaatcacaaatagaaaataaacagagaaaaaagaaacttactgcagggctctgttgtcttttctgaaatataaacaaaaataaatatataagtatcatttgcctatgggaaggaaagtccagatttctttaatactatttttgtgtataacttatagtattgaaaataatagtaagtaaagagatcaaaaccttttcaaagaagtaataaactaaagcccagcaagttaagggagttcctgggagttcaaggatttgctgagggttctgtcttccacagaatacaaatataaatatgtgagtgtggttttctttatggaagaggcccaatctgtcattttcctctgataatccttttgaggagattctttttaaagctagactattttagagccatcatctttatctgctcttcttggtctttatagtaaaaatgtcataggtttgggaaatgtgtgcatccattttgtcctcctttcatctttttttatttcaggagctatcgagatttctataaatttgctgagaaatggggaagtaacttctattttttgttcagaaagttttgctacaaatgatcaaatctttatttttaattaaggaaaaggattctatttttattttttagtgaggaacatgagaaaatgaacctatagtattggaatagaaaagtcagtttcaatggaatcaatcatcttgtgtatcttttgttgtaatttaagaatagtgccaatctggttcttttcagatttcctgagtttagtagattgagggcaacaacattcgtggctatttttctgtgcctttggttgaaacttcattataagtttaaggcattagaatttgtgaatcttgctttattcacattttcatcatattggacaaaaagggaaagggaatgaaatataggaacatggagctttttgtaacatccatagttattaatattgccttctgtacctatcatggacaaagaaaagtagacattttttcctccttaaaatgcttataaaaataaatgatcatgatttgccttagatataaagtaatgtggggtttattttgcctatgattcttttcaagcccacaattctctttatttttttaaaagatttatttatttgagaggagagagcgagagagagcatgaacagggaggaagggcagaaggcaaggagagcaaactccctgcttagcagggaaacctgatgtgcagcttgatcccaagaccctgagattatgacctgagccaaaggcagacacttaaggcagaggtttaaccgactgagccacccaggtgcccccacaattttcttcaaaaagaaattgggatttgaatgcaaccttggagacactacatatattaaatttccatatatatatatatatatatatatatatatataatttttattggagttcgatttgccaacatgtagtataacacccagtgctcatctcgtcaagtgcccccctcagtgcccgtcacccagtcaccccatccccccgtccacttccctttccactatcccttgtttgtttcccagagttaggaatgtctcatgttttacctcttcccgtgttctatcttatttcttctctcatactctcactccattcacaccaccccatcctaagtctgctaaactatttgttgaaaaggcagtattagtaatactaagaggttttatttctacaacttaagaaacatgtaaaattatatacacatatacatgtatgcatgtaggatgcatatgtatgtgtaaatatgtttggtacttctccatccagaaaggatttatggcagcttctcttgctgtttattctttttgttgtaatattgaacaggaaaatttacatagattttattgggtatggagcagttccaattctttcatgtctggcatttgatgtggggttgccagtgacatcaactcatcctaataatattgagtaaagcagagtgagagaaccagaaactatagttaatatttatgaatcttaatttggttagaaaaacattgatttgctgttctcctttccagatttgaacacatttcaaattgctaccattgggctattagcattatttcttacatcattatcgtactgatatataatttgtattattaatttgtaaagagttgatttctttgaataaggcaatggttgaatgatctatgtgctttgcaaggaaaagggactttctattttttaaaaatatatgtgatggaatagaactttcttaataatcaagtgtagtctaattgttctccacaggttatttactttcatgaagagatataacgaagttattagttggttacatggagtttatggttacatgtatggttttcttcaaatgacttctgagttccttagagacagactgatgttaacaacttggcataatagatataaattaatatttgctgaattatactggaaaattatactttaaataacccttatttccaaaaaagaacccattccttgtagaaaatacaaaactagagaacttctcagtccatcagaattatcaaagaaatccagattcactataacttttgcagaaactaaaaagtactagtttatcaagggactatcagttttctgggtgtctgattactgagtcatcgctatgaagttgtagaagaaagggctatcatagcccagtggagagtcagatcaagaaattctagtgtttgcattataaattttgcttagtctctttagtaatactgagggataatctcattacccaggttaattgtcctctggtgaagccaatggctcaattgttcattctctttttaaaaaaaatattttatttatttattcatgagaaacacacacacagagagagagaaagagagaaagagagagagagagagagagaggcagagacacaggcagagggagaagcaggctccatgcagggagcctgatgtgggacttgatgccaggtctccaggatcaggccctggactgaagatggtgctaaactgctgagccacacgggctgccccaattgttcattttccattgtattttgttttgttattattattatttagtcacccaagtcaggtgtgcctgacaatgtggaagatcatcatggaaaggggaagggtagacacatttacttgcatgggctttttccttcttcttcctctgttatcactctggctaataaattggctctagactgccacaatccgacacagtatggtagcagttttatgcttttcttgcttacaaaatggatcaaagcattcccctctttgttccatgcacagataatgatatcttccatttacaaagagagttttgtttttttaatcttagttcctgagaacggtaataaaaatataaacagagtttcagagcttaggtatcaatcatctattttctaatatagcatactttagattttacagactaggaaattaaggcctagagaggttaactgatattcccaaataattaacctaaaaaggattcagagtcagacgagaaatgtctgctgattttaaattcagttcttgtggaatcagaaaaaactctatttgaatagccaggggaatattaaaaaagaaaaccatagctgggggcatcacaatgccagatttcaggttgtactacaaagctgtggggaagaaatgtgtgggaaatatcagaaagggagacagaacgtaaagactgctaactctgggaaacgaactaggggtggtagaaggggaggagggcggggggtgggagtgaatgggtgacgggcactgggggttattctgtatgttagtaaattgaacaccaataaaaaataaattaaaaaaaacaaaacaaaacaaaacaaagctgtggtcatcaagacagtgtggtactggcacaaaaacagacacatagatcaatggaacagaatagagaatccagaagtggaccctcaactctatggtcaggtaatatttgacaaagcaggaaagactatccactggaaaaaagtctcttcaataaatggtactgggaaaactggacagccacatgcagaagaatgaaactagaccattctcttataccatacaaaaagataaactcaaaatggatgaaagctctaaatgtgagacaagaatccaccaaaatcctagaagagaacgcaggcaacatccattttgaacttggccacagcaacttcttgcaagatacatccataaaggcaagggaaacaaaagaaaaaatgaattattggaacttcatcaagatcaaaatcttctgggtgacgggcacagaggtgggaccttgacgggatgagcactgggtgttattctgtatgttggcaaattgaacaccaataaaaaataaatttataaaagaaaaagaatacagtatacaatacaaataaaaaaaagaaggtgtggtctatgtatacaatggaatattcctcagccattagaaaggacaaatacccaccatttgcttctacgtggatgaaactagagggtattatgctgagtgaaataagttaatcggagaaggacaaacattatatggtctcattcatttggggaatacaaaagttagtgaaagggaataaaggggaaaggagagaaaatgagtgaaaatatcagtgagggcgacaaaacatgagagacacctaactctgggaaatgaacaaggggtagtggaaaggggaaagtgggcgggaggttgggatgacttggtgatcagcactgaggggggcacttgatgggatgagcactgggtgttatgctatgtgttggaaaattgaactcctataaaaaaataaataaattcagttctttccacatcataatgttatgtcccctgcttatggatattttgagtgggtcttcagatggtcacagagtatcttctctggtgtaactattatttaaagcatgattttacccaaaagaaagtatttcctcttacttcttaggtctgtttatctgaggggaaaacttaagaacaggaactctggaaattcaagatttcaaggaattgaattcaatgaattcaagacagtcaattatttgtttagctgaaaaaagaaatgtagaatgtataggttgttcactttaattgcttgataatcttagtatgggtcattgttccctaagcatgatacctatttcattctaaaggacttgatgtgccaaattataatcagtgggctcttttctgttgctcttcagcaatatttagtatttatcttatttaatatgtagaatgatgacatgtaatgatgtgagtacattgtgactccctattcttcccactttactctctaaaacaatttgatagccataggaaggccagctgttagaaaatgggggaattttgaaactcctggttctatagagatcttcacggagcaagagtaggaaaaacttttccttgaagctatagtagagatgaggtgttagtactaatttaagagcttttcttgtggcctggggaaaatatcaagatttcctggttcattagcagagtgtagcatatgaaaaactgtgaagcacactgggaaaagctgttcttttccactcatttgtgttcctgggagagtattcttgatcctacccatagtgctgagccagatttctcccagttcttatttttaaggaagagctagctaagggaggacatggaaataagaaaacttcctttctgtatctcaatataagaacaagaatttaccattttgtacacagaaaatcaataataaaagcccatcctaccatgacttctatggcatagtgattgccaatgggtgagaaatcctaagagttggttagttaatctgatggctaagagcaaattttcctgaagaagtaaagaaatatatgtcactcaaaagctggagggaggaaaaccaagttggatgtctaaaacatgtcttctagggaagtagaactaataaaagctcaaagaagagtactaagataaaaattgttaaaggtagtaaaaatcagcctaacaaaaaaggtatttgaatttattttgggtttggtgataagtttttggatataacacttcacatctatgaaagaaataattgataatctgtattttattaaaattaattttttttgttttgtgaaagacattgataggccacagattgggacaaagtctttgcaaaagacctatctgatacaagccaaaatatacaaaggactcttgaaccttcataataagaaaaaggaacaccttggttgaaaatgtacaaaaaatctgaatagatacttcaccaaagaagatacacagatgacaaatatatgaataggtgctccacatcctgcctcatcaggaaaatgtaaataaaaaaaaacaaaaaacgagaaaccactgcctacctgttagaatgggcaaaacctctgacatcatcaaatggtagcaaggaggtggaacaacagaaactctaattcattgttggtgggaatgtagacggtatatttcctttggtatagcttgatgatttcatggaaattttactatgtgatcaggcagtcctgtaccttggtattccccaaggagttggaaacatatccacacagaaatctgcacatgaatatgtatagcagctctatccatcattgaaaaaacttggaagcaagtaaggtatccttcagtaggtgaatgggtaaatgaactgtggtacacacatacaatggaatattattcagtgctaaaatgatgtgagctatgacctcaattcccttatgaataaaaagacaaactgagctcaaagttagcagaaggaaggaaacaataaggattaaatcagaaataaatgaaatgaagaacaggaaaacaatagaaagtattaacaaactaagagttggttctttgaaaagataaaattgacaaactttaagctaggctaacctaggaaaaaaaaaaggaggacctaaatcaagattatagggatccctgggtggcgcagcggtttggcgcctgcctttggcccagggcgcgatcctggaaacccgggatcgagtcccacatagggctcccggtgcatggagcctgcttctccctccgcctatgtctctgcctctctctctctctctctgtgtgactatcataaataaataaaaaattaaaaaaataaatcaagattataaatgaaagagaagacattatatctagtactacagaaatataaaggattatagaagctgttatgaacaactatatgccaacaaactggacagcctagaagaaatgggaaaatacttagaaacatgtaacctaccaagattaaaacaaggagaaatagaaaatctgaacagacttattactagtaaggtgattgaatcaaataaaaaaaaaatctcccaacaaagaaaatcccagaaccagatgacttcattgttgaattttaccaaaaatttaaagaaaaattaatgccaatacttctcaaactcttccaaaaataaaggaggaaggaacactatcaaaatcattttatgaggccagcgttattctgattacaaagccagaaaatgacactatgagataagaaactacaggtccatgtctctgatgaatatggatgcaaaaactgtcaataaaatactaacaaaaagaattcagcagcatattaaagcagcattcaccaggttgggtggaatttattcctgggatgcaaggatggttcaacacattcaaatcaatgaatgtgatatgtcaaattcatatctatatcgaatatagaatgaaagaaaaatctttctataggtgcagaaaaaatatttgacaaaattcaacacaattcacaataaaacctcaaaatttagcatagagggagcttaactcaatcttgttaaggccatgtatgataagcctgcagcacagctaatgttatacttaatggtgaaaggttgaaagcttttcctctaaaattaggaacaagacaaggatttccattgtcaggcaagaaaaagaaataaaaggcatcagagttggaaaggaaaaagcaaaattatattttgctggtgacatgattttatacatatataaaatcctgaagactcaaccaaaaaactgttagatctaatcaacaaatttagtaaagttgcaggatacaaaattcatctacaaaaatcagtagtgttcctttacactaataacaaattgtctgaaaaaagaaataaaggaaacaatctcacttacaatagcattaaaaacaattacttaggaataaatttaactgaggatatgaaagatgtgtacactgaaaactacaagatattagtgcaaaaaattaaataagatgcaaataaagtggaaagttatcttgtgtttagaaaatggaaaaatactattaaaatgtacattttgccaaaggccatctgtagtttcagtgcaatccctatgaagattccgatggctgtatcctttgctgtgcagaagcttcttatcttgatgaagtcccaatagttcatttttgcttttgtttcttttgacttcgtggatgaatctctcaagaagttactgtggctgagttcaaaaagggtgttgcctgtgttctcctctaggattttgatggaatcctgtcttacatttagatctttcatccattttgagtttatctttgtgtatggtgcaagagagtggtctagtttcattcttttgcatgtggatgtccaattttcccagcaccatttattgaagagactgtctttcttccaatggatagtctttcctcctttatcgaatatcagttgaccataaagttgaaggtccacttctggattctctattctgttccattgatctatgtgtctgtttttgtgccagtaccacactgtcttgatgaccacagctttgtagtacaacctgaagtctggcaatgtgatgcccccagctatggtattcttttttaaaattcccctggctattcagggtcttttctgattccacgcaaatcttaaaataatttgttctaactctctgaagaaagtccatggtattttgatagggattgcattaaacgtgtaaattgccctgggtaacattgacattttcgcaatattaattctgccaatccatgagcatggaatatttttccatctctttgtgtcttcctcaatttctttcagaagtgttctatagtttttagggtatagatcctttccctctttggttaggtttattcctaggtatcttatgcttttgggtgcaattgtaaatgggatgcagagaaaagggaaccctcttacactgttggtggggatgtgaactggtgcagccactctggaaaactgtatggaggttcctcaaagagttaaaaatagacctgccctacgacccagcaattgcactgctggggatttaccccaaagatacagatgcaatgaaacgccgggacacatgcaccccgatgtttctagcagcaatgtccacaatagccaaactgtggaaggagcttcggtgtccatcgaaagatgaatggataaagaagatgtggtctatgtatacaatggaatattactcagccattagaaatgacaaatacccaccatttgcttcaacgtggatggaactggagggaattatgctgagtgaagtaagtcaattggagaaggacaaacattatatgttctcattcatttggggaatataaataatagtgaaagggaatataagagaagggagaagaaatgtgtgggaaatatcagaaagggagacagaacataaagactcctaactctgggaaacgaactaggggtggaggaaggggaggagggtggggggtgggggtgagtgggtgatgggcactgaggggggcacttgacgggatgagcactgggtgttattctgtatgttggtaaattgaacaccaataaaaaataaatttattaaaaaaaccaaaatttgaataattctacaagatttaaagtaattgcctcttaattaaaaatctcataagaaataccccacacccagatggtgacattagtgaatctaccaaatgtttgagatcgagctcttccatgtaatagaaaaaacctaattccccctccattttatgaagccagagtatccaggataccaaaaccgaataaggacattttcaaaaggaaagatacaggtgaatatttttcatgaaaatgtaaaaatcgtaaacacattattagtaaactaaatcaaaccctccccttcacatatatgttatcatgaccaagtctggtttatttcagaaatgcaagattagtttaacactcaaaaggctcaattgctgtcagcatgataatagtggaataaagaataatcatgtgatcatcttagtagatgtagaagtatcaaatttattcataataaaaactcttagaaaataaatagaagacaagcaagactagaatacctacagtaaatataattctgactaaagtgttgacagcttttcctctgacgttagtaacaggaaaatgaagcttgccattgcaatttctattcaaaatagagttcttagccattggaagaagacaacaaaaagaaatgctaaacagtgccattccaaaagaagaaacgaaacttggtatttgcagatgaccaggttgtgaatatagaacattcataataatatagattacgtgaataatagattagataatcaaaattgctgaatgtaaagttaatataaaaattcagttgtattttatataaaaacaaaaattaaatggaattttaaaaaagttataatttacaataatgtaaaaatttattaaattttaaggtattgaaggatatgcaagacctcaacataggaaactataaaactatactcagaaaaattaaagactgatacatggaaagaaagatcttattaatgggttggaagactcataaagatgtaaattatccccaaataaactatagattcaatgcaattctaaacaaaatgcctgcaggtttttcctttccttttcttgtttggtgtgtgtgtgtatgtgtgtatgcatgtgacttaaaaatctctaaaagattctaaaaggcacaccaagaaacagattcttaactatagagaacaaactgctggttaccagagggaataggtgtggggatgggctaaataggtgatggggattaagaactgctttgtgtgagcaccaagcattgcatagaattgtttaatcactagattttacacctaaaactcatattacaatgtacataagctaactggaatttaaatgaggacttaaaaaaaaacaaagaaaattagagggagaactcaaagatatatatatgtatgtatatagtttacatggcataatgtatgtccaaaagagccaaggaaacaataagacaagaggagtagatcaggatatgcctaatagacattcagactttcctacagcttgtgtaatcaaagcagtatgacactgacatcgtttttttttttttactatgacctcataagatttcttaagatgtttttattctaatcatctcctttgtaagatttccatattacaaatatactatgaatttgcttatacatttcatgaatatattatacatctgcctatgtattttatgaatatctgtaatttatacattaatagaatacaattttttgaccctcaagaacctatttttgcttcctggagggcatcattactgccattgaaagagtatgattaagtgggaaaaggtttattttacaaatactgctgacaaatttgatctccatctggaagagaataagactagacatcaatttcacaccataaacaaataggtttaataaatatgaaagagaaaatttttaggaaaaaaatgaatatgtgtaccacagtagtagaggaaacccatttgaaagcctagaagctttcaggcttaaggcttacatttgaccaaatgtaataaatttttgtatagtaaaatatgcctttattttatttcatttcagttaacaattttttttgcatctactatgtgggagatacttttttaagcactagctattcagcagtgaacaaaatatagtgcttgtcttcagagtttatgttctatgggagcagaaagtcaaaaaaatacatgtgaagtgaaagtgaaaaataatgtgaagtagtaataaatgctatgaagaaaaagaaatcaggacaaagggatagagagggtagaaatactgttttagttagggtagtcatattttcgctgacatcttaaagaagtgaggaagtgagttgtgcaaatgttccaggaagacctgcagtgggaacatgcttggcaggtatggagaacaatgaagccacagtgtggctgcagcaatgagggagacactgggaaatgaggctggagaagccagaaactgtgtactatgaggccttgaagtcttgagagctttgtacttttacactaaagtgattggaagacctttggaaagccttgagcagagaagtaatatgatctaatttacattttaaaagtaggattctgggttgcctgggtggttcatttggttaagcatctgactcttcttggtttcagcttaaatcatgatggtgagaatcaggatggtgagaatcaggatggtgagatggagcccatattgggctccacattgggcatgggacctgttcgagattctctctctccctctctgccctgtcatgtttgtgtgctctctatctcaaaataaaattagaaaataattagaacatgggacgtctgggtggctcagtggttaagcgtctgccttcagctcagggtgtgatcctatagtcctgggattgagtcccacattgggctccctgcatggagcctgcttcttcctctgcctgtgtctctgcctctctatctctctgtgtctctcatgaataaataaataaaatcagaaaaaaataattagaacaaaagtatgattctgacttagtgagggacagtaggctgagagtggggaatgagatcaagagctctcttcagaggctatcacagcagtacaggtgacctgtggtgaaggcttggattacctgataaggaggtgagaagtgtcagcttcaggatataattttaggggacaggatgaatgattggatatagagcaacaacaagcaaattgagaaaaaaaatttgaacacatatgataggtgaaaaacattaatagacaaaaagcttctacttgaattgaaattgaataagaaaaggacaaaccaccagtatagtaaatgaataattcacagaagagcaagtcaaaaagactaagaagcctgtaagaaatgctcagtctcactaggtgttagggaaatgcaatcaaagcaagagttagacattactttccccatgacagagacaaaaaagagttagctactacacttctcattattatttttctcagtagctgctgtttgtagcaccagtgagagtgtggggaaaatagagctcagacatccttggtcagaatgtgaatggttagggattttggggaaagtgattacatattttcgttaacattaaaaatattttcattagcactaaaaatatatattttctttttctcttgactttccagtttcacttttggaaatctatcctagagaaataaaatccttaacatgtaccaagatgtttattatagcaccatttggcccatggcaaaaaagctgaaaaacaaacaaagtccattgtttttttttttttttcaaagtccattgttaaagaattggttgaatatacagtaattcatccactctactgtaataataatgctttagagtgatgtcctttgacttggagtgatgcatgtgacataatgttaggtgaaaaaatcaagttgcagaatgatgtgtgtaggttgactccatttgcatatatgtttatatgagcatggattaagatagagattcataggaagttaacactgataacatcacaagtttttaatttttgcagagaaatttaataaagatttaaataaaatatttttgagaactgggttacaatgtatataatctgtagtgtggtatctcttagattttacttcctagccttgtcagatggttaagattttggatgatgatggataagttctcaaacactagaaaaacaggcttctatttcttcaaaacctaattgggacccatcaggtacagagtagcgacattggctgattctcctattcttaattgttttattttatttttttttaaatttttatttacttatgatagtcacagagagagagagagaggcagagacataggcagagggagaagcaggcaccatgcaccgggagcccaacgtgggattcgatcctgggtctccaggatcgcgccctgggccaaaggcaggcgctaaaccgctgcgccacccagggatcccccttaattgttttaaaacgagggtaatgaaatttcatccaatgtaaaactgaatattctgatcaatttttcagtttaaccttttatccctttgaatcctgttttaaattctatgcttttccttttttttttttaaagattttatttattcatcacacacacatacacacacacagacacaggcagaaggaggctgcatgcagggagcccaatgtgggacttgatcccaggactctgggatcatgccctgagccaaaggcagatgctcaacccctaatccatccaggaatcctgcttttcctttttcaccagttccctgtattcatttcttagatatgctagttataacctggggcaggagatatttgtgagcaaaggtaaattgcacttttaatgcagttctaacctaggaaatctttaattggggtaagagccgcattatctgattttacataaattgtttacttcccaatatcttggcatttcctatttagctttgttatcttaaaactcaatttcctgcttttccttacatatgttatgctcttttcctacacataaaatgactaaaggtaagacgtctactcattcttttttctgtttattgagataaaactgacaaaaattgtacatatttaaggtagaagacttgatcccccccaccgagttttgttgagctgtaattgacatacaacatagtttaagtttaaagtgtttgacctaatgatatatgtatatattatgaaatgattaccataataagtttagttaacatgggtcacctcacatggttacaaattttcttttttcctcgtgataagaacttttaagatctaagcagggcatttgtgaacagggatttgacatgtatattagcgtatttgtgaaacaaaatttaccacttaattttttaagtcctactttactatctttatatctaaattatcttggaattgcatgtacttattcattttcctagtatttgcatcattttgctaagcatggtgttattttgatagcttactcctttctccttccttcttctagggtcctttaaaacttccatacctgtatctgtaagggaagattagcaattgtttttaactggcctgccttttggtggcctttagagaatggcaaacaattttcatagttgtagtttcctactatataacttatattattttttattttttttattttatttatttttatttatttatgatagtcacggagagagagagagaggcagagacacaggcagagggagaagcaggctccatgcaccgggagcccgacgtgggactcgatcccgggtctcgaggatcgcgccctgggccaaaggcaggcgccaaaccgctgcgccacccagggatccctataacttatattattatattacttatttgccttcaagatctagcggaaatgaaaatgtttgacttatttgttgacaaattctgtggaatatacttctttaaccattctttctttaaattctcatctttcgttatcagaacatttattgtacagattttccttacatcttctcataccttaatttttttctttgacctattatatctaacaggctcagttcttggacctgtgcttttgctagctctgtactttcttctttggggaactcatttattctatggcttcagttatctctaccggacggacttcagcttcctctcaaatgacaagtgttagtttgtttaactcagcaatttgttattgcctccctgtcctacaagttagctcccagtttgttatggattttctgtcacccagtttcaaaagttatgaaataatcatttttttcttttccctacttatatgtagtcatcatgaagtagtgatttcttctttgaaaaaatacctcatatctatcccttctatttagtctctttccatcacttattaccccaaacatctcttcactagatttactatctatgatgtttctcctcctcagtctattttgtacaatcacaaggttgcacactttagtaatgcaaccttattcacctaactctccttcccaaataccctagaaggcttcccagttgcctgatgaataaagtataaattcctagtttgttttcatattccttcagaatcttcttctaactctcctttacagaattgtatccagagtgcttcttctgagcctgctgtaacgataaaattgcctacttctcctagagcatggtgtggcagcattgaattcttttgcctttcttgtacttttcctacctcactcagtgtatcaacatcttatccatctttcaagacacatataccaaccaccattcccttccccacgaagctgtcccctttatcttcttgttccaagaggctgctaactcataccatccatctaaactacaatttgacagattttacttttaaaagattatcctgtgtacacatattatatcactatatgtgttaaaagctattttattgcagagtcagacatatatttctgtaaccctaattgctagaacggtgcctcatgaacattgagcttagcatgaggagcattgattggttgattggttacactgtcactgagttaatatcatcattgccaaaggaaattatacatttctttaatcagaatgttttatttcagaaagtatccagtctttcttgactaagcccataaaagtatcaacttagaaaaccaagaattaaaaggtgagatttgtggttaagaggactaaaaatggtgaaacatctatagtaggcactctatagatgtataaattaaagggattttataattatgatccatttagcaataactgggttgtgacttgtatctggaggatgggaatcagaaaaatcagttgactttatgagccttcttttattttacccttactcttttcatctttttgttgtactttcttcccttacttatctttgctccttagtgaaccttctttttttttactcttgacttctgattctttccttcttttaactttgtacttttctacatccctttttttcatagcatcattttcttctgtatctttcttcttccttgcatcttcctttcctttgtcttgctttatttgatcctcagaattctcttcctttacttgagattcctgaacttgcagtatttcagacccacttttctctacttggtactcctgctcttgtggtattccatcttcattattttctacttggtagtcctgtccttctggtattccagcttcattactctctacttgggactcttgtccttctgatattccagcttcattattctctacttgggactcctgtccttgtggtattctggactctctcctctttacttgggtttcctctccttttggtattcccatgtcactcatttttacttggtcttcctctcttagtatcctggtctcactctccttttctatgatctccattcctatccttccattctccaactcaatgccttttgttttccattttgactctgttttgtgccttgatgtcaaggattcatcagaatctatgactaaaatttccttctttagtgttttcttgttttcttcttggctgctctcagactttgtagtggctccattttttagaatctgggccttgaaatctgatttttttgcaagttctgcatccatgcaacctggaaatataactgagcacataacaaaagtgcacaattcagatatcaagtactttctctttattgctacttttccccctgatattggtttattttttttgtcttaaaactgaaaaactgaagatagcttgagatttcctgaaaatataaaatgatggaactctacacttaaattatacaagtattgataatattccagattctctttaataaattggaagattaatgaaagaagaggtaaaatgaactataaatgaactggccgcttttgttcagtatattatggctgataattaaagcttaatagctaaaggaggatgtgttctgaaaagaaatggaatttatttttagaaaaattgtggaaagaagtaataattgtttcttaaaatagaaaaaactcaaaatatgctttgagtattgaatataagaatgtcctctcaatcaaaagtaataatagtactagctggtaattattgggtacttatcatacatcaggcactccctgttctgagcattttatataaaatattaattcacttaattctcacaactaaaagggcaggtactactattattcccattttacagatgaagaaattgagtaaatgaatgtgaatatggccatggagttattcagtggtggagctgggatttgaaactggagtcagacttcagagttcagtctgttccttatgataacggcaaacttactttacaaaaatttctggtccctttttccatgtacaggtaagtcagctctactatgtctcaacttctgtgtgatctaataaactgaattttttagcttccactttattttttcttattttagtgatttggtttcctggattaagaaaaaataatttatgctaccaggaaaaattctgcgggttcttgctatggaggagtggcacaccttcctataagaaaacctatttaaatatttaatggggtagaaagaatactgaatttaaaagctgaatcagaacacctgggtatagtattcttgctagctgggtttgtttgggaaaatcagttaatccccaaagattcaccttcctttttttttttttaattttttaaattggagttcaatttgccaacatatagcataacacccagtgctcatcctggtcaagtgcccccctcagtgcctgtcacccaatcaccccaacccccccccacctcccctttcaccaccacttgttcctttccagagttaggagtctctcatgttctgtctccctctctgatatttcccactcattttctctcctttctcctttattccctttcactagttgtgtatattccccaaatgaatgagaccatataagattcatcttccttttattttgtttcctctgcctactttagagttaaggattctaaggaaatatttaagaagcatggcttttactaacagactgtttcaaatcctggcttcatacctaaccagccaggtgagtttgggcaaaccttactttcttatttgtaaaatgggtacaatagttgtaggtacttcacagaagtgttatgaggattaaataatctaagtaaagcactcagtatagtgcatggaacatagtaaaattgtccaacaaatattggctattattactaccaattagatcatacaggcaaaaactctctctgatctattaagacaaggcattcttagttccaaccaaatactttagagaaatggttaattgctttacaggaggatttcttgcttaagatttgacctttttcttttcatagaaaaccttttaatatgtttagggtttgatgtctgaaatattgacatacacataaccaaaaaacaaatagtaaaacgtgacacacctgcattagataagaaggtaagtataaatcaaaagagatgttgtagtgtttcctttttgatattttaggttctgacacaaaatgaaaataacactaagaatgttgcaataatgctttactgtgttttttcctccctaatgtactgacattttattctagacaaagccatttccaatttactaataaatatcaatagtaaaatatcctaagcattttagtacttagagagttcagaatattttgatatctaacagtactaccagtagacacttgttttttgggaggatgtggtgtggtgtggaaaagagcatgtttttccactgaagcttccaaccttacaaattctgtggaatgtactccttaacaagctaatttttcttaatatttcttaatatgcatatctaccatctcttgggagtttcatatttactactgtgtactgcagacccatttttaagctaacttcacatcctaaattatatagatttttgttaataaaaatattctaggatttaatgaaacaatgtttattctagctacaattttcctaattttatagtattttaaagaattttattttttcccactaaactaaaaaatacttatagtcacttctaatagtatcttcatatctttgttttaattctttgctgtatattttctattttgaacctaatagcataggagaagtaagctgcaaatcattattccatcaaattctaagctcttccctctcccttctttcaaatttctagttagtgcatacatctttttttccccttagatctcataatctacatgatataaagatttgtaagccctagctgaaagtccatttactgcaggtggtaggctatatggcaaaattctaattataagggaatatttcccccaagatcttggcaattgttataatgtattcagtgtacctaaagattttaagctggattaatttttgttaaagctaaaagatatcatgaattagctatcatagtaataattctaattatataataactttaaataatgtagcaactaaaccatggctttattaggaaattattcctattaggttattaatccagtggctgccagagagagtacactcagatctagagcataaagatctgttaagcattaggaggatgactcattgtagatctcagtccatgaattaacatttagaaaaaaaaatcatatacttagttagctgaatgtggagatgagaagttaagagaatcaacttgagagggtgatgaagtttaatgagctgatctgtcttcaatctttctttgaaccacaaattaaactttaatctcttttcgctaaaaatatcaactgggaagaatatgtttgaaatattcttgtcaacaaaaatatatcttttacaagaaaaaaattttaaagattgaactgatttttttctggcaatttaaaaaaattcattaaaaacgaattcacctccagggagggccttggcctatggtcccttctcaaagccttttttctctttgtaaagaaaacatacactcttatcaccttccccatgtcatttgtgagctgcagatacatcatgactgctctgaatgcttattcttcagagcagtcatgctgtgttgtgaatgtgaatgcaaagaaaacaattatacctttcaacttttcctcctcccactcacaaacccactctactagtgtgaactgataaagaagaatgattaaatataaagacatattttgtgttagtgtttggaaagtttgagatgctaaatttaagttttgcttgcttcctatggttgtacctttacagagttttaagaattattattgtgtttcataggattttcttgaagagctgaggcattaaataatcctgatgggaaatctgaatttagaaaacagttaaaagccaaacattgatctaaatgggatatcttttatttttattttatttttttgatatcttgattcttttgtgtacatttaattatatatcttccctagtgcatgtctatttgtatttagaaacattttatttatagatatggtttcaggactaatcccaaaaaaggcatttgtggttcagtatagaaggcaatgtgttggcatggaaagagtatgtaattcagagacaggaagtcttggcagtgctgtttaccaattctttaaccttgggcaagtgtctgagcaattttactgatctgtgaagtgtagaataacaatagctagcaggcaggctatgataagaataagagataatatttttgaaaatgcctagcatggtgcatagtatatggaggggctcagtacctactattcctcaaaagtagaattacttagaaggcaagataacgtttttttttaactagttattttttctgttaatcggattcactgggccttcacttataacgaaaaaagagttctaagttactagcaaagaactcacacaatttagaaaccaatctttctttcattatattttgctgggagttagaaaggagatttttttttcagagcctagaagatggccagagattacagcatccttttgtatgaacttcatcaaatcctctacagctgtctctccaaaaatagttatttaaaatattagaaaattctggagaataggaacatttaaaatgatcttagaaacacaaatctctaatttgggagtagaaacagcaaatccagaaaatataaacaatgtaaaatatcatggttgagaatagataaagaacttacccataggagatattgctaaaaataaaacacaaaaggttaatcagagggaattttttaactcaagtaaagtctcactcccttttagaggaatgcagaagcagcaccttcaggtcctataaaaccctctgtttcatcctcaggagtgctgctgaccaaagctccacatcctacttcacagagctggttttctttaggatgccatttgccaatccatatgccatttgccatatgggattgaatcctaggtaatatctattctaccaaatttcaaactattgcattttctactgtaatttttctctcacaagtcagtttttttgcccactgtcctttagatccgttgaaaaaatgtgtattgttgaccaattttcaaaatcatcacttagtgtcatcctgacacttattttttctgtcaattttaggtgattttctttttttagtgaaaattcaccattgccagatgatagcacaaggaaaatagcctcccttgtggtaaactagctgggtatacatactaccaataatctttggcagtcgataaccagagtaatgagacaagatcattatcttttgttccaaaagagaaatagagaagaaattgaagtataataacatcatttctttaagaaatattgactactctaaagtagaagaatgtgaaataaaaaaaaattgggtaacaaaaactcaaaggtcctagacacagaaataggtaaggccaagaaatgatccaaacttacttatttttccagaactgtccactgaaaaagacaaaaaaatatcagtaggtattgggttttcccttcttctccaacctgcactcctctgcactggatggatatctatgtcatgaataagttccttttatttaaatgtagggaacctccattttctttccctgtcctcttggcctgttgtagtttagaaagatcttgtgattagctattttatgaaaagagttttattaagatatatatttggcatatagcattgtataaatttaaggtatatgcaatatgtcaatttgatacattagtatattataatgattgccattgtagaaataattagaacctctgtcacattacataataatactttcttgtgattggaatcatgaagttctagtgtctaagcaagtttgatgattgtcctacaatattgtctatattcattatattatgcattagatctctaggacttatttactacttgtaagtttgtacctttgaatagtgtctcctattcccccacccacaatcccctagtaaccccattttactgtcattttttagaaataaatttagctcttctagattccacatataaatattatacagtacttgtcttcctctgtcagactttttcattcagccttatatgttcaaggtccatctatgttgttgcaaatggcaggatgttctcctttctctttgtgaaataatatatcctatgtgtgtgtgtgtgtatgcctgtgtgtgtatctcgtatcctttttatccattcatccattggtataggcagttattttgtttctgttccttgcaactgtgaataatgctgcaatgaacgtgagagtatatatatatataaatgtgtgtatatacacacacacatatgcaggactcgatctcaggaccccaggatcactacctgagccaaaggcagatgctccaccactgagccaccgagacatccttatttttaatttttttttgataggcctccatgttgttttccatagcagttgagccactttactttcccattaacagcatacagtggtttgctttctccatattcttgccaacacctcttgtgttcttgatcatagccattttagcaggtgtgaggtgatatctcattgtagttttgattgcatttctcttgataattagtgatgctgaccatttttttcatctgcctgttgagcacttggatatcttctttggaaaaatatctgtttagtttctcagattcttttttgttatggaattgtatgagttctttatatattttggatattaactcattatctaattaatagtttgcaaaaagtttttcccattccatgggttttcttttccctttgttgattgtttttttcatgtgcagaagcctttaaatttgatgtagtctaacttgttgatatttgtttttgttgtttgtgcttttggtgtcctgctcagaaaatcaatgccaagacctacattgaggagcttcttctctatgtttttttcctaaggcttttatggtatcaggttttaagtttaagtctgtgaaccatttcaagttaatttttgtgagtggtgtaagataaggatataattttattgtttttcagggtttttaaagttttcattttaattccagttagttgacatacagtgttatattagttccacgtatacaatataccgattttttaaaaaagatttattcatgagagacacatacagagagggagagagaggcagagggcaaagcaagctctatgcagggagcctgaggtgggactcgatcccaggtctccaggatcatgccctgggccgaaagcagcactaaaccgctgagccacccggggtgccccaatatactgattttaatacttccatacaacacccagtgctcatgacggcaggggcactccttaatccccatcatctatttcacctgccctcccacccaccaccatcagtttgttctctataattaagtctgtttcttggttggtctctcttcccctccccccttattctttttggtttttgaattccacatatgagtgaaatcatatggcatttatttgtttttctctgactgacttatttcacttagccttatataacctagctccagtcatgtctttgcaaatggcaacatctcattcttttttatgactgaataacattccattgtgtatgtttataccactttctttatccattcatcagttgatggacatgtgggctgcttccataatttggctattgtaaataatgctgctataaacacagagatgcacatatctatttgaattagtatttttgtatcttttgggtaaatacccagtaatgcaattgctggatcatagcatagtttctttttttccctttttgagaagcctccgtactgttttccaaagtgatcacacgagtttgcattcccaccaacagtgcacaagtgttccttttttcccacatcttcaccattacctgttatttcttgtgttgttgatcttagccaatttgacaggtgtgaggtagtttcgatttgcatttttctaacgatgagtgatgataagtatcttttaatgtatctgttggccatctgtaggtcttcttggggaaaatatcttttcatatcttctgtccattttttatttggattatttgttttttggttgttaagttttataaattctttatatatttttgatactaatcctttatcaggtatatcacttgcaaatcttttctgccattctgcaggttgcttaggtttattgattgtttccttttctgtgcagaagatttttattttgatgtagtcccaatagtttatgtttgcttttatttcccttgcctcaggagacatagttaaaaaaatgttgctgcatttgatgtcaaagcgctaaaccactttgcggtttaaactgcctgtgtttgctcctatgatttttatggcttaagtttcacatttaggacttcaatctattttgaatttatttttatgtgtggttgtaagaaagtgatccagttgcattcttttgcatataactgtccagttttcccaacaccatttatgggaagtattgtctttactgtattggatgatattctttcctgctttgtccaagttgatttaacaatattattatattattacttctggattttctattctgttctatcgatctgtgagtctatttttgtgcctgtaccatactatcttgattcttgcatctttgtaatataacttgaaatcgagaattgtggtacctccagctttgcttttcttcttcaagattgctttggctattcagggtcttttgtggttccatacaaatgttgattgtttattctagttctgtgaaaaacacttgttattttaataggaattgcattaaatgtgcagattgctttgggtagtatagacattttaacaaagtttttcttccaatccatgagcgtggaatgtctttccatttctttgtgtcttctcaatttctttcattggtgttttatagttttcagagtacaggtcttttatctttctggttaggtttattcctatgtatcttattattttgcatacagttgtaaatgggattactttcttaatttctctttctactgcttcgttattggtctatagagatacaatagatttctgtacattaattttgtatcctatgaccttactgaattcattgatcagttcctgtttgtgtgtgtgtgtgtgtgtgtgtgtgtgtgtgtgtgtgtggagtattttgggttttccatacatactatcatgtcatctgcaaatactgaaagtgttatttcttccttaccaatttggatgtcttttatttctttttgttttcttatttctgtggctaggagttccagtaccaagttgaataatagtgatgagagtggacatccttgccttgttcctgatggtaagggaaaagctcacaggttttcctcattaagaatgatgttagctgtgactttttcacatatggactttattatgttgaggtatattccatctaaacctactttgttgagggttttaatcatgaatggagttgtactttgtcagatgttttttatccatctattgaaatgttcatatggctcttatgctttctcttactgatgtgatgcatcatgtgatttatttgtgaatattgaaccatccttgcaacccagtaataaatcccacttgatcacggtgaatgattttttatagtgtattgttcaatttggcttactagtattttattgaggacttctgtgtctatgttcatcagagatattggccagcagttctctttttttttcatggtgtctttttttttttaactttatttgaaacacagtgagaaagtaagagagatcacagagggagagggaaaggagactctgctgagcagagagcctgacgagggacttgatcacaggaccctaagatcatgaattgaactgaaggcagataaacttaactgactgagccactcaggtgccccttacctggtgtctttggttttgttttcagggtaatgctggccccatggaatgaatgtggaagtttttcttccttttctgtttttttggaatagcttgagaaataaaggtattaactcttctttaaatgtttgataattttcctgcaaaaccatctggcctttcatttgttgctaggttttcttttcttttcttttttttaaaattcattttctttgctggttatcagtctgttcaagtattctatttcttcctgttttggttttggtaggttatttgtttgtaggaatttatttatttcttctaagttgtccaatttgttggcatatggtttttcatgatattctcttataattgtatttctgtggtattggttgttatttcttctctcttatttgtgattttatttatttgagttctttttctttttttaaagttgataagtctggctaaaagtttatccatttttattaattttttcaaagaaccagctcctggttccatttttttttttagtttttatattatttatttatgctctaatctttattatttccttccttctgctgttttgtttttctttttctagctctgctagttgtaagattagatttagtttttttctcttgcttcttgaggtaggctggtattgctataaacttccctcttagaaccacttttgctgcatctcaaaggttttgaaccattgtgttttcgctttcatttgtttccatgtactttaaaatttttttcttttaatttctggctgacccgtttcttctttagtgtcatatttaacctctatgtatttgtggtctttccatatatatatatatttttgtggttgacctttagtttcaaagcattgtgatcagaaaagatgcatggtatgactttgatcttcttgaatttgttgaggcttgttttatgggttaataaagtgatctattctggagaatgttccatgtgcacttgaaaagaatgtgtattcctctgttttagaatggagtgttctaagtgtacttgttaaatgtattagttccagtgtgtcattcaaagccattttttccttgtggattttctctgcagatcatctgtccattgctataagtggggtgttaaaattccctagtattattgttgctctgcatgtttgtattttgttttcctagcaccatttattaaaaagattatcctttctccattgagtgtttttggctctccttgaatattagttgactgcatatggggggtttagttttggcctattctgtctattggttcatatgtctattttcatatcagtactgtattgtttttattattatagatttatagtacagtttaaaatcaggaattgtgatgcctctagcttttctctccacccttttagattgctttggctattcggggttttttggtgttaccatccaaattttagaactagaatagaattttagaatagacaaaacgtctatttatgtgaaaagttattggtattttagttggcctttcactgaatctatatacagctttgggtagtatgggccagcccatgaacacaggatgttttttcatttgtttttacctttttaaatttctttcatcaaagtcttgtagttttgttgtacagatctttcatttccttggttaaattaattcctaggtattttattgtttctgatgtgttatgaatgggatggttttctttatttgtctttcagatatttcattagtagtgtgcagaaatgcatgctgattttacatcctgctgctttattgaagtggttgattagttccaacagtttttagcttcagtctttgggattttctctatacaagatcagatcatctgcaaatagtgacaattttacttgttcttttgcaatttggataccttttatttcttttactcattaaattgatgtggccaggacttttagtactattattaaataagaatagtgaaggtgggcatctttgtcttatttctgatcttaagaggaaaagcacccagtttttcacttttgagtgtaatcttagctgtaggtttgtcatatgtagcctcaattatgttaaggtatattctttgtatacccaattcatgcaaagttttgatcatgaaaggatgttatgttttgtcaagtgtttttcccacacctattgagatcatattcttttatctctcattctatgaaaatgatgtattaaatttgttgatttgtgtatgttgaaccagacacacattccaggtaaaatctcacttggttgtggtatataatcattttaggggggtcttaaattcagtttgaattcagtttagaatttttgcatgtatatcaatcagggatattggtctgagttttattttcttgtagtgttcttatttggctttgttatgaggcctacaatgagtccaaaatgttccctcctcttcaagttttgggaagaatttgtgaggaattggtgttaattctttaaatatttggtgtctacatttaaagtgaaaccatctggtcctggagttttctgtgttggtaggtttttgattattaattcagtctctaaacttgtcattagtctatgcagattttctttttctttctttcattttctttttttgcctgattcagtctttgtaggttgtatgattctagagattttttccatttcttttacataatttgttagcaaataattgtttatagtagtctcttatgatcctatgtatttctgtagtgttcattttaatgtctcttctttcatttttagttttacttatttgaattttcttttttgcttagttattccagctaaagatttgtcagttttttaatcatttcaaaaaccatttcttagttttgttgattctgtgtattgtttttctggtctctatttcatgtatttccactttgatctttattatttcctttcttctgctgactttggacttaatttgttcttttcctaatttctttgttttaataaattttttttttgcttggttatgggttttatttatttatttttttaatttattttttattggtgttcaatttactaacatacagaataacccccagtgcccgtcacccattcactcccaccccccgccctcctccccttctaccacccctagttcgtttcccagagttagcagtctttacgttctgtctccctttctgatatttcccacacatttcttctcccttcccttatattccctttcactattatttatattccccaaatgaatgagaacatataatgtttgtccttctccgactgacttacttcactcagcataataccctccagttccattcatctttgtaggacaccgaggctcctcccacagtttggctatcgactccgtccacagtttggctatcgcataaaccacatcatctttatccattcatttttcgatggacaccgaggctctttacacagtttggctattgtggacattgctgctagaaacatcggggtgcaggtgtcccggcatttcattgcatctgaatctttagggtaaatccccaacagtgcaattgctggatcgtagggcaggtctatttttaactctgaggaacctccacacagttttccagagtggctgcaccagttcacattcccaccaacagtgtaagagggttcccttttctccgcatcctctccaacatttgtggtttcctgccttgttaattttccacattctcactggtgtgaggtggtatctcattgtggttttgatttgtatttccctgatggcaggtgatgcagagcattttctcatgtgcatgttggccatgtctatgtcttcctctgtgagatttctgttcatgtcttttgcccatttcatgattggattctttgtttctttggtgttgagtttaagaagttctttatagatcttggaaactagccctttatctgatatgtcatttgcaaatatcttctcccattctgtaggttgtcttttagttttgttgactgtatcctttgctgtgcaaaagcttcctatcttgatgaagtcccaatagttcatttttgcttttgtttcttttgccttcatggatgtatcttgcaagaagttactgtggtcaagttcaaaaagggtgttgcctgtgttctcctctaggattttgacggaatcttgtctcacatttagatctttcatccattttgagtttatctttgtgtatggtgaaagagagtggtctagtttcattcttctgcatgtggatgtccaattttcccagcaccatttattgaagagactgtctttcttccaatagatagtctttcctcctttatcgaatattacttgaacataaagttcagagtccacttctgggttctctattttgttccattgatctatgtgtctgtttttgtgccagtaccacactgtcttgatgaccacagctttgtagtacaacctgaaatctggcattctgatgcccccacatatggttttcttttttaaaattcccctggctattcggggtcttttctgattccacacaaatcttaaaataatttgttctaactctctgaagaaagtccatggtattttgatagggattgcattaaacgtgtaaattgccctgggtaaccttgacattttcacaatattaattctgccaatccatgagcatggaatatttttccatctctttgtgtcttcctcaatttctttcagaagtgttctatagttttgagggtatagatcctttacctctttggttaggtttattcctaggtatcttatgcttttgggtgcaattgtaaatgggattgactccttaatttctctttcttcagtctcattgttactgtatagaaatgccattgatttctgggcattgattttgtatcctgccacgctaccgaattgctgtatgagttctagcaatcttggggtggaggcttttgggttttctatgtagagtaccatgtcatcagcaaagagggagagcttgacttcttctttaccaatttgaatgcctttaatgtctttttgttgtctgattgctgagtataggacttcgagtaccatgttgaatagcagtggtgagagtggacatccctgtcttgttcctgatcttaggggaaaggcttccagtgcttccccattgagaatgatatttgctgtgggcttttcatagatggcttttaagatgtcgaagaatgttccctctatccctacactctgaagagttttgatcagaaatggatgctgtattttgtcaaatgctttctctgcatctaatgagaggatcatatggttcttggtttttctcttgctgatatgatgaatcacattgattgttttaggagtgttgaaccagccttgtgtcccggggataaatcctacttggtcatgttgaataattttcttaatgtgttgttggatcctattggctagtatcttgttgagaatttttgcatccatgttcttcagtgatattggtctgtaattctcctttttggtggggtctttggttttggaattaaggtggtgctggcttcatagaacgaatttgaaagtaccccatctctttctatatttccaaacagctttagtagaataggtatggtttcttctttaaacgtttgatagaattcccctgggaagccatctggccctggactcttgtgtcttgggaggttttgatgactgcttcaatttcctccctggttattggcctgttcaggttttctatttcttcctgttccagttttggtagtttgtgactttccagaaatgcgtccatttcttctagattgcctaatttattggcatatagctgctcataatatgtttttaaaatcgtttgtatttccttggtgttggtagtgatctttctcattcatgattttattaatttgagtcttctccctcttctttttaataaggttcactaatggtttatctatcttattaattctttcaaagaaccaactcctggttctgttgatctgttccacagttcttctggtctcaattttgttgagttctgctcaacttttaattaactgtcttctgctgggcgtagggtccatctgctgttttttctctagctcctttatgtgtaaggttagcttttgtatttgagttctttccagtttttgaatggatgcttgtattgcgatgtatttccccttaggactgcttttgctgcatcccaaagattttgaatggttgtatcttcattctcattagtttccatgaatctttttaattcttccttaatgtcctggttgaccatttcatattttagcaggatgggtaacctccacgtgtttgaggtccttccaaacttcttgttgggatttagttttaatttcaaggcattatggtctgagaatatgcaggggatgatcccaatcttttggtatcggttaagacccgatttgtgatccagtatgtggtctattctggagaaagttccatgtgcacttgagaagaatgtgtattcagttgagtttggatgtaaagttctgtagatatctgtgaaatccatctggtccagtgtatcatttaaagctctcatttctttggagatgttgtgcttagaagacctatcgagggtagaaagagctagattgaagtcaccaagtataagtgtattattatctaagtatttcttcactttggttattaattggtttaaatatttggcagctcccacatttggggcataattattgaggattgttaagtcctcttgttggatagatcctttaagtatgagatagtgtccctcttcatctctcactacagtctttggggtaaattttagtttatctgatataaggatggctacccctgctttcttttgaggaccattagtatggtaaatggttctccaaccttttattttcaggctgtaggtgtccttctgtctaaaatgagtctcttgtagacagcaaatagatgggtcctgcttttttatccagtctgaaaccctgcgccttttgatggggtcattaagcccgttcacattcagaggtactattgagagatatgagtttagtgtcaccatgatacctattcagttcttgtttttgtggattgtttcattgaacttattcttaaaggggaattttaagagtcccccttaaaatttcttgcagagctggtttggaggtcacatattctttcagttccttcctgtcttggaagttgtttatctctccttccattttgaatgagagccttgctggataaagtattcttggttgcatgttcttctcatttaggaccctgaatatatcctgccagccctttctggcctgccaggtttctgtggagaggtctgctgttaccctgatattcctccccataaaagtcaggatttcttgtctcttgctgctttaaggatcttctctttatctttggaatttgcaagcttcactattaaatgtcgaggtgttgaacggtttttattgattttagggggggatctctctatttcctggatctgaatgcctgtttcccttcccagattaggaaagttttcagctaggatttgtttaaatacatattctggccctctgcccctttcagcgcccttgggaaccccaattaaacataggtttttcttcctcaggctgtcgtttatttcccttaatctgtcttcatcgtcttttaattgtctgcctcttttttcctcagtttccctctttgccatcaacttgtcttctatgtcactcacccattcttccacctcgttaaccctcgtccttaggacttctagtttggattgcatctcattcaattgatttttaatttctgcctgattagctctaaattctgcagtcatgaagtctcttgagtcctttatgcttttttctagagccaccagtagctgtataatagtgcttctgaattggctttctgacattgaattgtaatccagattttgtaactgtgggagagaggactgtttctgattctttcttttgaggtgaggttttccttctagtcattttgctcagtgcagagtgaccaaaaacaagttgtattgggaaaaggagaaaaagagagagagagaaagaaagaaaagagaaaaagaaaaaaggaagaaaaaaggaaaaaagaagaaaaagaaagaaaaagaaagaaaggtgaaaaaaaaaggggggtgggggaagcaatcagaaatcaaaaagaaaacaaaaacaaaaactaaaacaaaaaccacgggggagtatcttctgattctgtacactttaagtcccttgacttcccctggaacttgtccgtctagctggtcttctgggggaggggcctgttgtgctgattttcaggtgttagcacttgggggagctgctctgcccctgcctggtgcagggctcagtgggggttgtttaccccgtgaggccccaggaggaacaaccgcagtggcggggccagctctggagccctagagtcagctcccgtagtaaccacagagctccctgtctgcagggcctggaggctcccggtcagggccgctgatctgctcagctcggggcaggagcgtcctcgctgtcttgggccctcccggcctctgcctgtcctgggggaggccggatcctgggctgtgtcctggcgccctgggctcggggcctgcactggtggattcgggctcccgccccgcagccccctccgcggagccaccgcccgagcccccccgagctgctcccgccccgcagccccctctgtggagccgccccggagccccccgagctgctcccgccccgcagccccttccgcggagccgcccctgagcccctccgagctgctcccgccccgcagccccctccgcggagctgcccccgagccccccgagctgctcccgccccgcagccccctccacggagccgcccccgagccccccgagctgctcccaccccgcagccccctccgcggagccgcggcccgagccccctgaggtgctccgggtccccccgtgcgcgctgccgcccaaagggagctcggcgcactctccttgggggcgcggttgctctgttactgtcccgggaaacccgagggcatccccgacctcctgggtcctgctccacctgcctggagccctttcccccgggaaggttggtgcagctcctccttctcagggacggggctctcctgtcctggggacactcgccccggcctcagcccggctcctcgcggggcccctcccccttggaggccttttgtttctttctttttccccgtcttcctaccttgatacaagcgcgaactcttctcactgtagcattccagctggtcgctctttaaatctcaggctgaattcgtagattttcaggatgatttgaaggttttctaggttatttggtggggacgggtgacttggggaccctactcttctgccatcgtgcccctcctcctcttttcctaatttcttgtggtataaagttaggtcgtttatttgaggtctttctaatttgttaaaatctgcatttattgctacagatttttctctcatcattgctttttccacataccataaattctggtatattgcattttcacttcaatttgtttcctaataattttttatttccccttgatttcttctctgacctgttggttgttcagaagtgagtttaattaccacatagttgtagattttccagatttccttttattttttatttctagttttataccatttacgttagaagacattattgatgtgattttagtcttctgaaacttgccaagatttattttgtgtcctatcatatgatctatcttgagaatgttccatgagcacttgcaaagattgtattctgctgctgttgatgaaatgttctgtgctttctatgtccatttagcgtaaagtatggttcaaatcctatgtttccttgttgatctctatctcaataatctatccattgctgatggtattgaactaccctacttttattgtattcctatttctcccttcagctctgttagtatttgcttaatatatttaggcattctagtgttggaagtgtatacatttatgactgttatattttcttgatgtattgaccattttatcatatttgtataatgactttcgtctttgtgactgcctttgacttaaagtctgttttgtctgatctaagcatagctatctccactttcttttggtttccatttgcctggaatatctttttccatctcttcgcattgagcctatgtgtgtctttagagctgaaataagtctccttgtggacagcatatggttgggtttagtttttgtatacattcagctactctctgctttttttgctgaatttaatccatttacatttatatgtaagacttactactgccgtcttattggaagctgcctccttcttctttcttcatttttcttttctctttgcttctgcttctgcttctgcttcaccttcttcttctttgccttcttttggtatctccaatctttccccatatgtttctgtccaactttgtaaattggtggcttaccatgatgatatgctcagtctctccatttttattttttgcaaatctactctagatttttgctttgttgttactataaggcttacatgaaacatctcattaatacaacaatccattttatgctaatgacaacttattttcatttgccttgaaagactctactcttatttatttgagggatagcaagaaaacaagtgtggctggaacataataaaaaaatataagatgaaggaaagctattagagaattatggggcatagatctttcaggaccttcttttgagaggttctgtaatgactttgaatcaagaaagatggagacttattagtagatcataggtagaaagatgacctgaatcttaaaatgatccctgtggctgctgtattgggattgactggaaggctagggtgaaatcagaggaattagagatatgaaagtaacttggataacagtgagaatcctaaaggtagtgagaagtaccagattattatttaatactgagggatctgctgtcctactataacactgtatcttgctaggagtcttgaatggtaccttagaagaattacggaaaaaaaaaaaaaaaaaaagaagaattacggaaataaggatacagaagaactgtgtttctgatcccaaaacactaccactaatatactttcttatttcaattttcataatacctcaagtagctactagtaagtttccaatctatttcttgtgctttagtttcttttagggcaaaagcaggccaattttgctatagagcactggataataaatattttaagctttataagccataagatcactgtcataactactcaactttgctgttgtggcacaaaagtattcatagacaatatgcaaaagaaaacaaaaaaggatgtgtcccaataaaacattacttgtagacaatgaaacttagattgcatatcattttcacatgtcataaaataccattcttatttcttgtgttgtgggttgttgatttgaggtattcttggtatattccttttatcattatgtaatgtcccttcttgcttctggcaaatttttgctctaagatctactttatatgatgttaatatagctacttttttttttaaaataatgctttatagtatatattttctataattttctttttattgctgaatttgaagtaagttccttaatgatagtgtatagttgggtcattgttaaattttgtattgatttttttaagttttatttaaaatccagatagttaatgtacagtataatattggtttcaggtgtacaaatttagagatcctacatttccacacatcacccagtactcttcacaacaaatgcactccttaatccctctcatcactgatttaactcattctcccacccacttcccttctggtaatcatcagttcgttctctatatttaagaatctgtttcttggtttgtgtctttcttttttcccctttactcatttgttttgtttcttaaagtccacatataagtgaaatcatatggtatttgtgtttgtctgactgacttattttgcttagcataacactctctagctccatctacatccttgcaaatagcaagatttcattcatttttatgacagtaatattccattgtgtgtgtgtatgtactccatgtattgtgtgtgtgtatgtactccatgtattctaggctcattcatggtgttgcaaatagtatgatcacatcttttttgtggatgtataagattacatatttattatatatgtatgtcatatatgtaaatatggtgagtgggatatgtatatataatttttcttttctttttttttaaatttttttgtttttatttatttatgatagtcagagagagagagagagagagagagagagagaggcagagacataggcagagggagaagcaggctccatgcaccgggagcccgacgtgggattcgatcccgggtctccaggatcacgccctgggccaaaggcaggcgctaaaccgctgcgccacccagggatccctataatttttcttcttcatttgtttatcgatggatacttaagttgcttctatatcttggctgttgtaaataatgcttcaataaacataatgcatatatcttttcaaattaatgtttttgttttctttgggtaaattattgtttcatatggtatttcttttctttttattttttgaagaacctctattctgttttctgctggaaaacaatttacattctcaccaacagtgcaccagagtttctttttttccacatcctcaacatttattttttcttgtgtttttgattttagccattctgaaaagtatgaggtgatatctcattgtggttttgatttgtttccttgataattagtagcattgagcatcttttcatgtatctgttggtcatgtatatgtcttctttgggaaaatatctagtcaaatcttctgcccattttaaaatcagattatttgtttgcaggagttcttaattttaatgaagtccaatttatcaattatttctttcatgaatcatgctcttagtgttatctctaaaaagtacttgcttttgtagcacatatactaaaacatcattaccatactgaaagtcatttagcttttctctgatgctatcttctagtagagttatagttttgagttttatatttaggtctacgatccattttgagttaatttttgtgaagcatgtaagatacgggagaagattttttgtttttaatggatgtccaattgttctaacattatttgttgaaaataatatctttgctccattgtattacctttcctcctttgtcagagattagttgactatatttatgtggactgagcggtctgttctgttctactgatttgtctctttgcctaccaatactacactatctggattactgaaactttataggcaagtcttgagggtgagtagtgtcagtcctccaacttttttctccttcaatattgtattggctattctgggtctttggcttcttcatataaattttagaactaatttgtcaatatccacaaaatatcttactgggattttgatggcattgcatttaatctagagataaatttgggaagaattgacattttgataatattgagtattcctattcatgaacatggaatatctttatatttatttggttcctgtttggttttatttattagagttttgttagtctttgtttttaaattggtgcatttagaacaacagttttttgttgtttgtttttatggaaatgcaaattttcatagttcacttgaatggtatgaaaggcatctcaattgagtctttctaggagaagtcagaaaaggctttcaaagtactgttcctcctaaccctttttctctgaacagcagtggtggttcaggtttagatgtgataaattttatgaaggagaggacaaagatcagcctttcttttttgtattcaactctattttagttagtgttttctttgtttgcatgtgcagaatctgtccttgtaatactctcactaatattcatatcttttcattattcatatctttccaccttttatcttttggaattttgttttgtgactgtagagcttcagactgaaatataaatttcatagtgtgttatttccaaggtttcctgtaatctgatcctatgatattttatcaacattgttttcctttgtttctcttctgtaacttaatactgtaaccaaatgaacaattttttttcctttgcccttactcttctatgggcctctgatatacaatctccttgccccaaaactatttgtaaatgaaagaagtactagaaaaatgtggaggagaagagatggaaaataatctctcagtgttcagagtggccagataattgaaagtatcagtgcaaataaagaaccctggttgttacagaggaaactgagaaacacaagtggaacttaccagctgctactggaccaattactaaaaaagaaaatagaatatattattatttttaaaaattttgtactcagttcctattgaaaatctacttggaacactggaaaagggacttttgggaaacaaatcttatatgaatatgctataccttattaattgaatattaactacactttaataacctaaatatccaggcgattttggaaagcctgttggatgggttataggagtaaagcttacttttcctaatgaaataattattttaacattcttaaccataccaagggtcacaatcttgcaggaaactggttaccagttaaaggttactaacttaagttccttcttcattttcttttctgtctttcagcattctatctccctttcaaacctctatcaccatgtcagttatcatcatatttctttttgcagtacagaaagtttatttgtaactatcaatttaagaactgttgtcatgataattttttctgtgtttctttttgataatctctgagatttaatcaggatgctaaatctagcctaagaagtagcataagtaagacatgtaacccatgtaagatgatagttctttcatgtctttcaaggatggggaatagggtagagtgaggattagtaataatagcaaatgagaaattccaaaagcttcaatctcctggtcctctttaataatcctttggtagttatctttatttagagtaagcaaagtggaattgaggttagcccctcttccttttcttatcaatttttatgagaacttaaaactcttcaggagctagcaatgattattcagatttcactcattttacttttcttcccacttcaatctcttatctcattatgtctttgttctattattcactttccaggttttttttgttttttaatatctgagctaagttcattactttgagaaatttgttctattttttcatgaaaagtccatattatgcctgtcctctttatcctttgcatcaatatatttttcatttaaaatcagtaattttaggaaatgcagaaaaatctgagagtgaagagatgggaaaatatgccacttaagttgcatttacagaagtgattacagcccatgagatttcatgcccatgaaagcatgaaacctgaaccctatgggagtccacaggatactagaattgccaagaaacagtattgataagtttagggggaaaaacaaaacaaaacaaaactttaataacctaacacaaaatttaagcttgtaaaaattcagttactaatcatattctttatagcagaaatgggaaagaattcctgaaactatattactttctaagaaggaagctgcaaagaaatatgataaatcaactcctccattattttgttcagtaaccttgggcaaagggcaaggctggaggcattaatatacccccaactttatataaactgcaggcaacagagtggtaggggatggtgtgcaataagaattattgttgttattaggagttattaatgtctagatattagtttccagttagtatatcaaatattatttcacacaattattattgataagtattatttatgaattttgagctaatagtgacttatgactgttattacagggatttattctttgctcatcagttatttagaaaagagttgaaatacagttactaggagaaaatggctgccctttgtatatgaggcacagggaatatggaaagctgctgaaaggcagctgctgagtttatatagaaaatctcatccaagtcaaagtcatacttccaatggggtcttgaacagaatttgtcttaattctagtgctcttaattattgtaagaatgaacaaatgttatataatctggtaaaaaatacccatctctctcacaacacctaaagtgaatgcactagcttatgtcaacttcaaagttctgactgccaaagaaaggattgaactactagaggtacttcagaatcatgtatcaaaaacataaaaatagacagcatagggaatatagccaatggtattgtctggtgacagatggtagctacacttgtggtgagcatagcataatgtacagagctgtcccatccactttgttatatacctgaaatatctgtacacaccattgtgtgtcaactgtactttaattaaaaaaaaaaagaaacaaaacagacaagtagatcttctctggaaagattactttaaatgagtaactactatggtctttctgagtaattgagttggtgaagtcataatcctttcatatcctaggatatgaaaaattaattctgttttatgtggtattgatcaggatggggaaatatacacagttcttaggaaattgggaaaaattccatattcatagataatttttgaaaaagtatttctcttggaaatcatccacttgaaaagtatgcaaaagtagaccctttgaagcctagtaggaggaaggaatcagatgttgcctgaattgaacttagctctcccaattttcatgccctttctcttttggctgagttttgatttctctgctctttctcactcttcatttttagatttctctggtggcttgatttgttgataaaatatttaaactgtcaccagtgtttgttttcctttattttcatttttttttaacagtagaggtttaggctttccactgatttatacataaataaatcaattgttccagtaatatggaataaggacaataaaaacatcacatttagagaagatagtagagataacacaaattcaagttttagagaaattactttacccaaagccatgtttggttaagtgttctggctgggatctgaactgagatccatctgattcctttattatccactgcaatatattaccttaacattttttacaaattaatacatgcaattggttttattatttagagttattccttaaggcatatgtcttgaaatggaattatgagttaagatactgtatttcattgtatcttgcaacatatttcaagtgtgctttccaaaaggaaatttccaaatttacataaatttaaatgggatcaatgatgtataaatgtataatttttaccaaagcattgccgacattacttatcatatttaaatttttctttttattaggtgaaaaatactacttcagggtcttaattttctatcatttatttatctatttacctaggccttgggcatattatagtttctaaattcatctgtcatttaaagaggtattagataatggggaggtaaagggggttgaaaatatcaacgtggaatcctttatttcagggaaatttttctaaagaacactggaattaagaaatagatgaataataacttaccaataggtactggagtaactggcagaacaacatgaaataaaaatatattaacagagtttttggataaaaaatagtttccttcttactttttccaatgtattagtaaagagatctttggaagaccccaaacctccccaaataaaaacatccatgatgaaataagagggattagcatttcttttgtggtacaaaagtagtttcagtctgatgtaactgggttccttatatttcaatttagtacaaaggcagagtaggctagaacttaagtgcttatgccaattgtttttctttctcatctagtatggaggatttaaatcctgcagagaacttttaaacaatagcaaatttaaatgctgattgcagttattttctttcctgtccttacacctaagatatcttcctgatttatcctcttttattggtacctccacatttgtgatatcccaccctatatatcttttcctgttagctgtatggcaaattttatttatcattaaaagctatttgaagttgtttttagaaaacaaaatgcttcttttatatttattctcttagtgaaatgtttattctttgttgagtaattaacaacccagcaagttgccaagagggagaggaaatatttataaatacaagcatggaatggaattggtcagttaggaaaattatctccttactttgggatcccaatttgtaccagatttatgaaaagaaaagaaacttactgataggtactgctacatgggctaaaatccaaacacaaattgttagtataggttgacactgataacaaaattgacattgacaatagtcttactgctactgtttgcagataggaatttctagaatgaaaagggaaagcaagctctggacctttgacatgagttactttgtctctcttttccaatagtaacacagtcattttgaaaaagtggcaaagaagtttcattttccttttatcatgcagtttctttcagaaattgaaataccacagagctggaaaagcctcatttcctacaaattttgcttccattttcattctactcccttctcttattgcttatgtgttttcccatttttctctgtcatttctactttatatttagttgaaaatgttttttgttgatatcagtagagccaatccaagtagattgaatgttaaggtctttcatattcagaaaaggatttgactagtggagccaaccccagaattgatgaataagatatagaacttacctggctcttcttgttttactgcaaaaaagaaatcaaataagtgagtgaaagatttctggatgaacagcagagttatttctcaaactttatgctagaagttttagaaataggacttcgagggaccaccaaattctgtatttagaatcagttcaatatgatgtgagaatatcttcagattgttctgctaatgtcctcttttttttttaatttattttttattggtgttcaatttactaacatacagaataacacccagtgcccgtcacccattcactcccaccccccgccctcctccccttctaccacccctagttcgtttcccagagttagcagtctttacgttctgtctccctttctgatatttcccacacatttcttctcccttcccttatattccctttcactattatttatattccccaaatgaatgagaacatataatgtttgtccttctccgactgacttacttcactcagcataataccctccagttccatccacgttgaagcaaatggtgggtatttgtcatttctaatagctgagtatgcaatgaaacgccgggacacctgcaccccgatgtttatagcagcaatggccacgatagccaaactgtggaaggagcctcggtgtccaacgaaagatgagtggataaagaagatgtggtttatgctaatgccctcttaatttgagtgccttttttggaaagaaaggttaagagtggaatcattgggagatgctatttcttccttctagtttctctgctaattcaaactgttcattgactggtaagatttttaagtcacttatattttgttttcttattgttattcctctcttcccatgacttctttgaaatgatggcattggtttatcatgaccattcatatgactcttgctttgctaattaccattcattatgtcaatttgggaaagttttcttttttccctataaacatacttgtcttagggctggatgaccatatgtctcaccatttgactgggatggaggcactgctggacctttagagtctggatttgaattccagcctctgttgctcataattgtgggatcataggcaatttacctagtctcactatgtcattctctttgtaatagcaataacaatacttatctgatataatgtatatgcgtatataaagccctgagtacagtgcctggcacattgtaattaccaaataaattttatttggtaccatattaagtaccaattagtttcaattatagccttcaaatgaacattgatagttgaaaatggaacaaactaccggaaataggaatagagaaacaaaaaattagaagatgaggaatgcttacaatattgatgaagcacaaagtcagaaatataactcttaaatcttgatacattcacattaaaacagagcacaaaagggcctctagataccataaaaaaacatttataacaatataattgagagaaacatggaacttactcttagatttctctggtcttgctttaataaaaaagacaaataaattagtgtggttgtctgataaaacagaaacacattttcactgatgtcattctaggatgaacatcacacactgaacaatagtgaaaaggattattaagcagggaccactttgccttgggaatgttctagaaggaaggatcctgagctagtgatggagctcacttttcctttttccctctagatccctgattgtgtgaagtcaggaaatgtgtcatatcccactctattttagttgagctactttcttggtcctcctttgtcattttacttttctagtcttcacccacaatctctgtctctgcagtcctcaccatggttccttacttgaattgcccactctgtcactttggtgagagtaggttttatttcctcttcattgaactccacacttagcatggtctctgcaacagcaggtacttaacaaatgtttactgaatcatgaaagagattctccctactgtagccagcatcagagtgctcctcctttccctctgttctcttcaagcaaccacgaggaagattttgtgccttataagtgaaacagggatggggcatatgaaggcatgcagtgatctctgctacaagattcatgagggtgagcaaaagagattgctgggagaggggtgactgtatgacattctgcgcctaaactctagaaaatttttagttgtaagattttgaaaatttgatcaggctaggaaaaataatttcaatggttttatttgttttttgtttttatttcataggggtgaaataataaatttttggggcagcttgttcttttgttctagagaatcactagaaagggctaggtgtgaaaaagcaaagcagggataatatgacaaagtaagatttgaaaaggagttatctgatacactattaccccaagcaatcaaaatacatgtaaaaatgaaaataccacacagaagaaaattgttttctaagtatgaatttgggttgcaataatggtgaaaactattccttcagtgggtaaaaatgtgtgtatgtgtattcttgttcacaattgactaagcagcaatttcactgaagtagtgttgtgaggctgctattttggggctcaggttataagtatcagtatgaaaattcaatttttcattgaacacagcaccccaagacactttgagatgagtgtttttttcagaaggcagcgccttgataaagaacggcatcactcatggaagtaagtggggctccttcaaatagcctcatggacagtgaataaaataagaggaaccagaagtttgttctggtagactaatgtgtaagattgtgtcatgactctctgagagattctcagagcttggaggaccaagatacattgcaagagaggctggatcttttacaggtggacatattggtgatccatagctaatgttgccatgatcacctaggtccttaggactttacagtattattgtctcatttgctttctttttattttgagatattgtaaaaaataataatacctcagaaatcaataatcatacgatctataatgtaacatttgtcatttttgttcacaatttttcttctaagaaagaaaataatatagggatgctgaaaaccctttgacttgaaatgaaccaccccgggttcattttcttccctcaattatgcattcagtgtgtatccaataatttttgaaggtactttcatatatatgtcgatccttcagcaatatgatgcattgtttccataatttcatttgtctgttttatagttcatggaatttctttaagggggttattgtgaatatcttgtccaatagtccatagattgtcatttctttagggtcagtcattggattttttattagtttcctttgatggagtcatatttccttgatcatttatgatttttgtggccttgtggtggcatctgcatttgagggagtaagcaccacttctagtctttacagactgaagttgacaggaaaaactctctggcattcaggccataagagattctgggtctgccctcttgggccatgtataagcttgctattagagtttttgggaaagtaggtctggttcctggattagcaggtaggtaggcctatttttgggtacatggaaaccagccttgtacctgggtctgctgggtcaagcctggggcctgtgttcactatggtgggcctggtccttgagtctgtgatgaagggattgtgacctggctcagctcagacagacctagatcctgtgtctacagctgccaaccaggcattggtaaccattgggctgttcccagcatctgagtctgtggagtttggtctcatacaaggatgggctggagcctgtcttcatgggagtgggtgtggcagctggggctgagggggaaatggcctggtgataaggttatcctggagccttggggataagtggggaatctgattcatgtgagttcatcaggagcctgatgccataggattcaaccagtacatgccagagtgagctgaggactctcctcccataattgtatctctctgtgctggaccatttgtgcatggaagaggggtgatatgagtaatatgaatctatccctcctaccttcctcagtgggtcttttcttatttctgcgctttacccaggttctatagcctctcatctggaatccttggctcttgtgaagatattattgcacatggatagttattcaaattgatgttcctgggtcagacaagtgctagaaattttgttgctgcaattttactaatgccactcctcattaaccccactgattagtgtacttccactgattagtttattcctgtgctaagaccacatgtgttcaatcagtattctttttaaaacgacttgataatcaaatgaaataactagggtgagccttccctcttgagaacactatgtttgtaaatatgttatttcttcttagattcttttttttctttttctttttttatataaaattttaaatggattattttatataattatatgaatttctttttatatgaattatatgaatattttcttttcttttttatatgaatcttttttatttgaaaacaatccttttggggatttttatttgaattttattgaattgtaaattggttgagaggagaattaacatgcatattgttattgaattttcctatctttgaaaatggtttatctatttattcaggtcttatgtttttaaaaggtattgtcaagaactggaggcatagtaaatactgagaaacattttctctttctctctttaagttgtcatgctttcagggagacatgattcagaactggctcacagaataaaagacatagtaatgtctattgcaatctacaaagttatagtcagtttgctcattattatcattagtgaataaatgaattctgcatgataattatatattgacaacagtcattatatatctgtctatatcagcattgtaaaagtcgacacttaaattatttctattagggagctggcaatatagagcaaatgggctttgggttttattttaggacccagtatattgatcaatgtaagagtagacaagaccatttagatggttggcctgtctttcctccctccttccttcccaccctttcttccttcctccttacttcttctcctttcctttcccctacctgcctcatttccccatattctctttcagtttatttcaggatacgagattttttccatctccggtaatatcaagactcaggcaaaattgctgaactggctaggttaaaaacaaggtgttccatttgacttctcagttaaattgtcttccctagaagaaaatacattttttagaggtttattcttatgtttattcttgtaagttttgtttctttcgtgaatagtataattttgttttcacattacattttcaaaattgttgttgctggcataaaaaatgttttcagtgttgtttttgcatttagcaactttgctgactttatattaagtattagtagttcatttttttgtagttttttaatgcaaataatcaatagtctgagaataataacgaacatctcccttctctttgtgtctttataactcttatttttgttttgctgcacaggctggtataaattggtagcagtaatctttttttctttttttaaagattttatttatttaatcatgagagacagggaagcagagacagagacagagggagaagtacactccctgtggggagtctgatgcagggctcgatcccaggaccctgggatcgtgacctgagacaaaggcggacactcagccaggtgccccgggagtagtaatctagttcttgattttgatttgaatggcaacgcttctacaattttgttttttagaatgataaaggaataaatctcctttattagattaaggatttttttttaaaagattttattcatgacacatacagagagagagagagaggcagagggagaagcaggcagggagcccaacgcgggactccatccggggtctccaggatcaggccctgggctgaaggcggcactaaactgctgagccacccggagtgcccaagtatgttcttatctattcccttttaaggaactttttatttcttgctaataagagttttgattaggattctgtgttgaatcttgtaaaatattttttctttataaatgatcatacttttttcttcttttatctatgaatttagcaaatttattgatagattttctataatttatatcctggttatgaggcattaaaattcaatatcactgtgtttatgatgagtgtatcattgtaccttttgtttaggattttgtatctgtatttctaggtaaaagatgtctatgcattttttaaaaaaagattttatttacttatttattgagagagagagtgagagagagcacgagcagagggaggggcagagggagaagcagactacacgttgagcagggagcccaatatgcggctcaatcttgggactctgggaatatgacctgagtccaagggagacgcttaagtgactcagtcacccaggcaccccttagcatttttttcttatacaattgttgccttgccttgaaatcaaggaatcataacatcataaaataagctgaagtagatttcatttctttcctattctttggaacaggaattgctttaaagttatatacttctagtcctcagtggatgcttttgatttgaggatttaaatctcttttctactggaatgttgttaattactatttcttaaaaatattacttggtattaattctctgaattctctgaattcctattacacacgaccttctcattacacccaagcattgttcttttctttaatatttttaatctcttcatctttgtgtactcttttgagagatttcctcagttctatcttccagtttactctttttagatgtgattagtataatacttaactattactgaaacaactatatatttacataccataaatattaaaatatcatttaattatctattgcttcaatttcagtaacagtttttcatttctaagatttaagctttgttgtttttatctaccttttctttttccgaaataccttaaaaaatatattttctttatcttttttatggatagtctttcctttatttccctttagagaagccaagacttatcaaaactctagcctttagttcctctttgatgctatactagctccactatatgctatatgctgtattatctgccttatctttcaagaaaatgaaaattttctttgagaataaaaattttctccttaacttctccagttaggcttttgttcccatctaccttatcaggattactgatgacttctgtcttataaaatccaatgatcaattcccagtccaaaactttatttctcagcagttcttaatgtaattattcattcattcatcctttctatcttaaaatactctgaattctatgacactctcaccttgttttttttctttctgcttactttatatgccagatatttttatgccaatattttggcatatactttatcagatatttctcttctttccaacctcaaaattgatgttcttgagctcaattcttagccatctatctttaattggtgatctaatttagtctagtggttttaaatgctaactattttgctgatcactgtcaaatttatactttacctgacttctcccagtagcttcagactcaaatatttaattgctttttgatacacagtatatgcttggatggggaacaagatgttgaggggggccctttcctattatccccaaattgacaattagtatcaaaaatttgagaaaaagagtttataacctcccatctccttcttgacccagctgaagtgagacaatccctcatgaagagactggcatagctgtgaagtctgtgttcccagacacaatggggagggattcctagaattgtgcaaatgcatatctggttctctcaggtcttaacaaatggtgtctaaattagttctctggtaccaaatgtgtctttcctttcaatctaaataagaaaacaactctaaggggaaggagacttaaggcaatcttcagagttgtgagtagttgactaaggaaaagcgttgtgggggaggaaggcatactgatatcctttctgaaagcaaatgagaaggacttcaagagatttgcttgcaaagattgggatgtttgtgggacaggatgtatagcaacttatcacttgggtaaatgtcttcaaagtagatttgctgatttgtttatgactatttgagcattaggaaaagaaaattggagagaaggaacagtgcacaatgatgaggatgcagtagagcaacaggtcttcttttcttttttcttgtagcaaggaggcttgagcttcagaaggattgaatgggcattgaagccatacttatataagacaaactagattttaaaccaaagactaataagagattaagaagggcactgtagctttttatttttttattttttattttttttgcactgtagctttttaaaaaaggagtctatccagcaagaagatctaacaattttaaatatttatgcccctaacttgggagcagccaaatatataaatcaataacaaacttaaagaaactaattgatagtaacacaacaatagtaggggactttaccaccccactcacagcaatggacatatcatctaagcaggagagcaacaaggaaataagggctttgaatgacacagttgaccagactgccttaaaagatatattcagagcattttatcctaaagcagcagaatacacactcttttcaagtgcacatagaacattctctagaatagattatatacggggtcacaaatcaggcctcgacaaatacaaaaatactgaaatcataccactcatattttcagaccacaatgctatgaaacttgaagtcaaccacaagaaaaaaaattggaaaaaccacaaatatatgaaggttaaagaacatcctaataaagaatgcattagttaaccaggaaattaaagaagaatttaaggaatacttggaagcaaatgaaaatgaaaacacagcagtccaaaacgtttgggatgtagcaaaggcagtcctaaaaggaagcatataacaatacatgcctttcgcaagaagcaggaaagctctcaaatgcataacctaacattacacctgaaggagctggaaaaagagcaggaaataaaacctaaatctagcagaagggaaataataaaggttagagcagaaataaatgatacaaaaatttttttaaaagatggaacagatcaatgaaactaggagttggttctttgaaagaactgacaaaattgataaccccttagccagacttatgaataagaaaagaaaagggacccaaacaataaagtcataaaggaagaggagaaatcacatccaacactacagaaatacaattatgagcgaatattatgagtaattatatgccaacagattaggcaatatggaagaaatggttacgttcttaaaaacatataaatgaccaagactgtatcaggaagatatagaaagtctgaacaaattcataaccagcaaagaaattgaaacagtaatcaaaaatttcccaaaataagagtccaaggctggatggcttctcagcagacttctaccaaacattaaagaagagttaatacctattcttctgagactattccaaaaaatagaaatgaaaggaaaatttcctaactcattctatgaggccagcattaccttgattctaaaaccagacaaagactccactaaaaaggagaatatagaccaatatccctgatgaacctggatgcaaaagttctcaacaagatactagcaaattaaatccaactgtatattagaaggatcatccaccacaaacatgtgggatttattcctgggttgcaagggtggtttcaccttgcaaattgatcaacatgataacaccacattgataaaagaaaggacaagcaccatatcatcctctcaatagatgtagaaaaagcatttgacaaagtaaagtctcccttcttgataaaaactctcaagaaaatagggataaaaagaacatacctcaacatcataaaggccacatgtgaaagacccacagctaatatcatcctcaatggggaaaaacagaactttttcctgaagatcaggaacacaacagggatgtccactctcaccactgttgttcaacatagtactgaaagtcctagcctcagcaactggacaacaataagatatagaaggcatccaaactggcaaagaaggagtcaaactatttgtagacaacatgaccctctaaatagaaaacctgaaagactccaccaaagaatttctaaaaattatacataaattaagcaaagttacagagtataaaattaatgtgcagaaatctgttgcatttctatacaccaaacaaagcagcgggaaatcaaggaatcgatcctatttgcaattgcaccaaaacaataacttatctagtaataaatctaactaaagaagtaaaaaatctatactctgagaactatagaacatctatgaaagaggacacaaagaaatgaaaaaacattccatgctcatggattggacgaacaaacattgttaaactgtctatattacccaagcaatctatacatttagtgcaacttctatcaaaataccaccagcaatttttacagagttagaacaagcaatccttaaatttgtatgggactacagaagacctcaagtagccaaaaacaattctgaaaaagaaaaaaaaaaaaacaaaactggaagcatcacaattccagacttcaaactatattacaaagctgtagtcatcaagacaatatggtactggcacaacagcagacacataggtcaatggaaccaaatagagaacccagtaatggacctcaactatatggtcactaatctttgatgaagccataaagaatatccaatggagaaaaagacagtctcttccacaaatggtattgagaaagctggacagctacctgcagaagaatgaaactgggccactttctgacactacacactaagataagttcaaaatggatgaaggagggcacctgggtggctaagtagttgagtgtctgccttcaactcagatcttgatcccagggtcctgggatcaagtcccatatcaggctaccctcagagagcctgcttctgcttcctatgtctctgcctctctctctgtctctcatgaataagtaaataaaatctttttaaaaatgggtgaaagacctaaatttgagacaagaaaccatcaaaatcatagagaagaacagagggagaaacctctttgaccttagccatagcaacttcttaccagacacatcaccacaggcaggggaaacaaaaaaatgaactattggaattcatcaggataaaaaaacttctgcacaacaagggatacaatcaacaaaattaaaagacagcctacagaatgggagaagatatttgcaaatatctgatatttgcaatatatctgataaagggttagtatccaaaatctacaaagaactttaaaaactcacaatccagttaataaatgagcagaagacatgaatagacacttttcgaaagaagacatccatatggctacagacacatgaaaagttgctcagcatcactatcattagggaaatacaaatcaaaattacaatgaggtaccatctcacacctgtcaggatggctataattaacaacacacaaaaacaacagttgttggtgaagatggagagaaaggggaagcctcttgcactgttggtgggaatgcaaactggtgcagccaatctggacaacagtatggaggttcctcaaaatgttaaaaagagaactacactgtgacctagcaattacactatctaggtatttagtcaaaaggtagaaatatacagatttgaagggatatatgcaccctgtataccatgctgtttatagcagcattatcaacaatagccaaactatggagagagctcaaatgttttttgactgatggatggataaaaagtatatggtatatatacacaatggaatattactcagccagcaaaaagaatgaattcttgccatttgcaacaacatatattgagctagaatgtattatgctaagtgcaataaggcagtcagagaaagacaaataccatatgatctcactaatatgtggaatttaagaaagaaaatagatgaacatatggaaagggggtaaagaaaaaaaagagagagggaaacaaggcataagagattcttaatgatagagaacaaactgagggttgatggagggaggtggatgggggattggctagatgggtaatgggtagtaaggagggcatttgttatgataagcactgggcattgtaagggatgaatcactgaattttactccagaaatcaatattgcactgtatgttaattacttaaattcaaattttaaaaggtgacatatattatgatacgaaaaaaaactgaggttgctggataaggtaaatgggtggtggacattaaggagggcacttgtaatgagcattgggtggtgttatatgcaagggatgaatcactaaattctgcccttgaaactaatactacactatgtgttaactaatatgaatttaaataaaatcttgaaacaaaataaagcaaaacagacataaaaaaaaaaagaggacatccaaccttgaacttttgagttggtatcttactcaacttcatgctactaccgtcaccaaataggtgacggtagtaacagactatgaggtatatatactgtgaggagtgaactgaggggctccagaataggctatactagagttagtactctcacatcagggactgtgcagtagagtcctcagaactgggcaagttcttgcagattccatcaaagaactcaacataaattctacaagacatttgattgcctactctaaataacattgaaaggcaaccagtctcatgtcctcagaaaaaaggactgcaactaacagagaaggtaatttgcatgcttaatgaagtgaaattcatctttctagcctcagctcagtgggaactgtaatcaaggaaggcggacagaaaggagaaggagactacacttcttccctattctgagtcagcgggcttaagactgactgctaaaatggagtatttcaagaggagtggttggaggatttttaattatttattatttattttttttaaaagattttatttatttattcatgagagagagagagaagcagagacacaggcagagtgagaagcagggtccacgtagggagccggttgcgaggctttatcccagatcccgggatcatgcctcaagccaaaggcagacagacgctcaaccgctgagccacccaggcgtcccagatttttaattatttacaatgactagagaattatgggttctaccccaaatgtatatacagggaagagactgcctgtaacctactgagtgcaaactttttaataaactagtcataaatgtccaagtgttttgcacaagtgcaaaactgaggtcaagattgcctctaaatctgtcctttttcccatctatctagattggtagatagccccatttttcttgttgctttggccccaaacctgaaaataacccttagttcatttccatttaaactcacagacttaacagcagaatctgttggttctaccttaataatacatggaatgtgaagacttctccccacctccactctgatcacttcttctcttgagctcctgcccatgtcttcccagttaatcctccacatagtagcctttgttatgaaattatgaagcagacataactccctgtttaaacccattagtggaccttcattataggtagagtaaaatctaccattttaaccaagggctacaagcctcaaatgtgtggcccctgtttctctgacctcatctcctatcatccctcttctttctttttatctctctaggctagagtatgcatccttacagcagaccctacatccttgttcttttgcctggaacactctttttcctctctatatgccatctttctctagtctcttctcttactatgcttatattttttatggcatttatctgaaagatatatattgatttgttatttgattgtttttatttcaaaatataaacttcttgaatgcagtggctttccccccccactattatattctcagtgtaatacctggcctagaataggcacccaatatatttttgttaaatgcattagtgtctttaaagatttaaaattttgaatgcctgggtggctcagttgccttcagctcagggcgtgatcctggggtccaggatcgagttctgcatcgggttccctatgaggagcctgcttcccgctctgcctatgtctctgcctctctgtctctcatgaataaataaatcttctaaaaaatatttaaaatttattattttagtcctcttcagattgctgcagctatatttctatgagttgaaattctccaatttgttgtggcttatgtcattcatgtggtgctgagtttcctcatacatttcataattttttttcgtagtctcttattctttgagaattatctttgtggatgttttatcctgtgaatattctgtgctggttcccttcttgtggggagttttgtggttgctgttgccttagctatcagggtacagcatcaccaaaccaaatttcagctgttttggcttgggattcctgcagtacatggatggcacacttccagcagggctttgagccctgagcagatgtaggtctggtgtcctacatgcagatgcatgatggagtctgcatgtgactccgttttcatggttatgacaggtaggcgaagatattttggttcttttccttggacaaacaggaaagttttgcttctagctttgctcagggagtctcaattccagttctcaccatgctaggttctgaaatcattctaccctcctgcctctctttatttatgcttaagtttagctgtgtagttttaatagtaataataaaaaaaatatagcagccaaaaccaagccagcccgaaagaagttagtgtattcttatttcctttagatacctgtttatctcctcctaatctcttgagtcttggattttaaaatctctttcatcccaccctttctggtgtccccactgaaaagaacactaaattcttcacttttagttctggattatagtttccatctgcaaaaccgatagtgccttctgctgaactcaggtgttcccaattacagggcttgttcccaaacatggacatctgatgtatccagcatcatccttgggtctacaccattggccctgttgactcagtattttcatctggcagtgagactagttagtcagcctccttgttcaggattcagaaagaacatgtagaatgtctatgttaacagtttcaattctccctcctcagataccaatctttgtgtcctaacattattgcagttattcagaagtattataaaaatataatcagaatgtgtttagttggaaatagaggggtgtgtaagcagtctgttagggtgatccagttgtatatcatattttaaaaattgggaaattttatctaacatctggattaagtcagatgctttggcaagtctagatctgcattcttgcatggagaaattggctagaactgagcagcagctaccctttttagactgtacatgatctttccactgttcctaggtgatgtgccttacctactcaattagtagtcttgacaagaactttgggctttaatagtaatgtaatttactttcaatctgaggaacctcaagggatattgatattacataaaaatcatttgtaacacaagtatgaggaccagatttaaattatggaaaattaggacatagtgtgaaaggtggtatcatgaattctatgttaaagatcattattgtcagtacttgatctggcttaaatactgagttactgttggtctgtttcctaggaaattgagttaataagtaatgggaactcctacagttatgaattaaaaagattatctggcagttctaatctggatgactttgggtaatgtgaaaacaaaaaaatatgagaaacatgaatctcaatcttttgtgccctttagaaatagaatatctgtgcttgggaaaagtctcacatttgacagattgataagtaaagaacttacttgaggttctctgtgaaatcactaaaaaataagcaaagagaaatccatgtaatttttcttaaatagaaaaaatatagtattatctaatattttccactggtgtctctgagggaaggacttgagtagacataagaagaaagcatgctttgaggaaaggtctatctccatttaaacatcattttggaattcctgtctgtctctcaaaaattttgcctacctctgttatttatattttcagggtttgttgttcatgttgctactcaactccttttcttttaatcagtattttcttaaattatctataatgtaggggaagctgtatagtaaggaagcaagagagcaatgagaaactcaaatcactttaacagaatgaagtcacttagactttcaagaccagaaaaccatagtggagaaacagatataatacttacttatgggaggcaggggcacaccttaaaaaaacaaattaggtatcagtgagtaattgtttgaaaggaacaagtatccttctagggaagcatatttgtgtgggggaagaggcttggtagtaacacagctcttggttcaaattatggttcagtgaactgtgttcttggacaagtatgtgcccctggtttcttagcacttgcaaagaagtacaaggtccaagaggtcttggatttactccaagaatcaaatgggaaatgatgtagttaaatcacctatatagttcttatcactgaggagatgcaaagtaaacaaatgtttgaaattaaataaatatgtttacttcacaggataagcagaaggcaaaggaaggtgacagctatgaatcttaggctactacacaggagttagaaatgagtagggcaggaacaggtccataggccttatagaaaacattaacaacaaaaaagaatttaaaaaacaaacaaactgaacttacctctgggcattgaaagtggtgggccagctgaaagagaagtatttttgcaagccttttctctcccactctttttttcctcttagtttggagagttcttttttatcaagtcattataacaatagggaaaatgttccctttggtctttatttagttttaatataaattgaaggattttaacttttcaaaaagcattagtaaccatgaaatttggccatgggaaggcaggtggttaaggaaatacatacccatgcccagaaaccccaggacagctggggaaagaagttataggaccccacagtggaggaaacatggaaggacttactgagggcaggtggaactgatccggctgaaaaacagaacagagaaaattatctccttttcctttcttctccattcattttgtttttcaatttgtgaaatatcttgtaacatgtcatttttaactgctgggaaaccctcccttctgatctttatttttttatgcaaatcgtggaatttgaattttttccataattgttaaaaagctaagagaattattggtggtgtgaatacgagatgtctaagaaacaggaacttcaagcctctaaaatcccaaatggctagggaaattttcctcagatatcttggaattcaaatgtagaaaaacagactgagtaggaagtccaagtgaaaaactgttttagaaacttctgatccccctctttctcttccattgttttccccttttctgtagacagcctcttgttggtggtctttgaaactaagcaaaatttttttctcccttgtttatataaatcagtagtgttagaactttcaaaaaaaaaaaaaaaagaactttctagtacattattaataacccagagggactttgataatgaaatagcaagtggccaagaggtacctcaaactctttggatgccaacatggccaaatagatactcttggaccacactaaaaaccaatcagtccccatgacagagaatgaaatgaacatacagacttactgtttgtctgaggtgttgatcctactgaaaaataagcagaaagacttcttattgccccctgcttatttactcccttattcattttttttctatcggtaacttttctagtcacataactgcttgaaaagtttttctgatcaggagtatttgaactttccagaaaacttacaatcatctggtgtgttcaggttgatggagaagcaaaagttaagaaaataggaattgcaagttgttgtactggaagtcaaattccaatagacattgctggacattgttaaatgcacagcagagacaaataaacaacctactaattgctcatgtagataacccacctggaaaacagatatattatctgtatctttgtttttcctgttcattttttctacttctatatggaaagtccctgacaatctttaaaccatggagaaatttttttctctgctctttaatttttaggtgactcagtaaacactttaaaacttattaataagctagtggaattctaagtaatggaaaaataagggtcagggaaataggagctttaagctattgctatcccaatatggatggataaatttttgtttaagtggatccattggacactgctggagataattgagttccatcatgaagggagatagtcaaacttacaagaggatcttgtagctgaaaaacaaagaaaaaaatcagcatggaaaggctggtgaaagaggaattcgttttcttggtagggaatatcaaaaatgttcatggagggtggatcaaacccttatagatattgttgtgcactgtgctggagaacagttgccatcatgccttaggggattctgtctcctgcttcctctgagagccttcaggaaagagagatgatttatctcttccctttttgcagtgagtggtaactgcttaaagtcctataggagattgctaatttaaactgtgctgcttttacttttctactccctattctattctgtgcaaacttcattcattcatacaaatgttctccccccacccttgttgacaagtcacaataagcatcagatagtttcctctggtattttcatgtaatattaagtattaatattaatacttaatattaaatagggttatcaagtagggtttgtattccacttcattcattcattcattgggatggatgcagtcaggtaatggaataagcaagagactgagaaacatgaacatctatacccacaggatagaagcaaaggattccagacctggaggaagccaaaggcaactactgtttaagaacaagtatggaacttactagtcatttctgaagtttcagctggtggaaaaatggtaaagaaagaaaagggagaaatcagggtgtgtagaatgaagagaactcaattctcccatgatggtttgagaagagtaactacagagaagatgcagggaactcttgtttccctagctcattgcacatagctcagtgcaatgtcttgatttaggtcccatctttgtgtttcacattctcagaccggcttctacttgtctggggcaggagagtagctgtccttcctttccagtccttccaggggaataaatgcttgaaatttctagaggttcataatatcttaagcttgtacttctatgtacttctatgtacttttgtcattctcattttcatttatttcttttccctatctaaccttttagctaatttgaaagttttcttcccacctttaaaaaaattttttttagtagtcctatttggagcacccatttttgttaattaaaaagaaataactagggcagccccggtggcacagcggtttagcgccgcctgcagcccggggtgtgatcctggagacccgggatcgagtcccacatcaggcttgttgcgtggagcctgcttctccttctgcctgtgtctctgcccctctctctctctatgaataagtaaataagaaaaaaaaaaaaaaagaaataactagtatattttgcattttcttcaaatcatctgtaatttaggggaaagctaggaaggaatacatgtactacaattttcagttatacattactgtatgttttaagtgtttacacatagggagagggaattaagcaggggagaaaagggaaatggaatccatgtacccatatggattctcaagcacatggtagctaattggggactttaagccagatgagacccttccgttaggcccagtgagatcctctgagatgagcagacttatgatttctcccttataagaattataagaacttccaaggctgtacgtcttggtgataattaagagtacctaaaaaggaggctccaatttaggtggataggggataaatgatggatcatgtttattcacaaaggaaggtatttagaaccagcatttagggcaggcaccatccagttttaatgatcatagtatgattgtgtgggagactgcctgccctttccaggttttgagttcctttccccaagatattgtagaactgtaaactccatggcaccagagattaaccaaatctatctcttttcttcatgactttatccccaagcctcagttcagttcctgatacaggagctcagctagttgaaggaatgtttgagtacatctgatttgctttctgatagtatcctcttgtttggcttaaactttggaatgctgtcacttaatttgcactctcagaatttccaatggcctgaggtttgtttgatattctggaatttgacactggttttgccctagctaatcacaatatgagcttacccttcactctttcacttatagtttgtagttgcctgatgcacctgccagttcctgtaattgcagcccacctaccatcatatcctgttccctgaagctctgtgtgtctgggtgtgtgtgagtgtgttgggtgtttggggtaagtgggcaggataagacatgaggaaagagaagactttgggagagaaaattggggaactcagtgtgactagatccttagtagtattccctgatatactttacccaggaaactgggaagaaaactgataagacctcagtctatttaaatttgatttttttccttcttttacatttatctttaaaatttgctttcctttttttcattttctttacactcattatctctgttgtctttgagtaggctctttatgaactacaaagtacctcagaagcgaaagctaccctttctttctttctctgttacttcagaaaattctacattattacagaaggcattatgaccattactggggacattttcttacttttttcctaaaaaaacaaaacacaatcctggagaactcccagcaaataggaactgaggtgcatgaaaacatgtataaaactgttgtctttatagtaatacatacatttgggacaggggacaggccctctatacactgtagaagatcaaagaacaccagaggaaaaagatagataagggacttaccactggtcccagtatattgcactaaaaatagaaacaaacataaattactctggttgttgaacatgataaacacacaaaccactgaggttttccaaaggagagcagttagatagcagttagcttcccagaattactaaatcccaatcttcagaattaaatattttattggactatatccttgccataagatcagactgtcctccaggagacttgtaatcctgtttcagttggaagacaaaccatttgatgctcgcctttcactactacgggtgtttgaagtgaaatcgttgttatattcctttacctccgttttcctcatcttttttctcttctgtcacttttttttactctcttggccatcctcctttgtcttcgttcttgtttcttatgtcctttcccagattctatttcatctttgctttggaacactttgtataatgtataccgatagaccactataattattattagaaaaatgttacgctgcctattacgaatttgagtaacatatatacgttgattatatatatatatatatatatatatatatatatatatatatatatatacaacttaccaataggtcctggagtttgcactaaaaataaatcaaaattggcatgttagtatgagtgtttggatgaaaaataaatttttcattaattttattctgggggtggggctttgggaagtagagtaggggagaagtgataacagtaataagaacattagggagaactaatccaggtatgatccatacaccaaaagagatatttagcatatattgcaattcagcctgagatgagggtctctctagaatccttgtcaacctaggagaggttagagacattaaaggttgaagatactgctttttaaaaaagttttatttattgatttgacaggagagagagagagagagagaccacaagcagggagagtagcagagggaaagggagaagcagactccctgtccagcagggagcctgacatgaggctcgattccaggaccaaaggatcatgatctgagctgaaggcagatgtttaactgactgagccacccaggcaccccagatactgctttttaaagggaccatccttgtactaaaatatttctgaccaactaatatgctttaggataggcatgaaggtaggagctaaggatgcagtcttctcacagcttccagcttactgactactgctttgatcagcttgattgtctctgggcaaagggtcaacaaaaccttcaatttttaatgagaatttggccttcagttgattttccagttctgattaaacctgctttcttacttggcaacgttctttttatcaaaaatgatccttggggtgtctgggtggttcagtcagttaagcatctttttttttttttttaagattttatttatttatttatgagtgacacacagagagaggcagagacataggcagagggagaacagggagcctgatgtggtacttgatcccgggactccaggatctcgccctgagctgaaagcaaatgcttaaccgctaagccacccaggtgtcccagcatccgactcttgatttcagctctggttatgatgtcagggttgtgagatggatccccacgttgggctccatgttcaaaatagagtctgcttaagactttctctctctctctctccttctgcccctcctctactctctctctctctctctctcaaataaataaacaaacaaacaaataaataaattttaaaaataaaaagaagaatgatccttggttggtagaaagccatatttttgggcttccctgaatgtagtgaccatgtatttgggcatgtttcttataggatccctgaaggttatgtatgtagagctcttataggatattttggctcctgaggcttctatgttaaggcagctcctctatgcagcctgtgcaaggtcaaagactagttcctaggtggctctgtagatacttgcatagaccacttctaggactactgccacagaagagagatggttgatgctaccctggtggcaagctgtgtttcctgtcttaagttccattgagtagcatggtgaaggctgggatcatcttgtgagtctgcctagttagttgaatctaaaaagaccagccttccttccagtgggcattgcggtgtctctcttctccatagctccttacttcatggcactcatcatgggaaataccccagttctaacccataagccccaaaaagctctgatttttttttcctgtgtgaaaaagctagaaggtggcttaccagttgtggatatcttgggccatgagtgtagacaagctagaaatttaggtattttgtaaaagtaatttaatgtttgcttttattgtatctataaaaaaattgcccttgattctggagtagaactcctaggacatctgccctttggtataagccactaaatctttagacagataatcatttcaaatatgattttgttttgttttcctatattttttactctttttccacttttaatatgtgactcctatagccttccttttcttctctttctcagctttatttatattcatttactctttttcttctcctgcctccaactcaatctttctccttccaattttcttcctacttttgttctttttaaactcttgatttttctcttttcagcatgtatcttcattctctattactctttgtattacattttctctcacttcctctcctcataaggtctttttatccccaaattttaatattacaagttcatttctaaaaaacattttgtttatttattcatgagagacacacagaaagacagaggcagagacacaggcagagggagaagcaggttccatgcaggaagcctgatgtgggactcgattccgggactccaggatcgcaccctgggccgaaggcaggagctaaactgctgagccacccagggatcccctataagtttatttaattcctaactaataacctattagaacactcaaaatggtagtggaaagagctcaagagtcagcacaacttcagtcctgatttcattattaactatcctccttcccttatttttttaggaataacttctgaacctcaatttttcatctttcaagatgggtataatatctgttatccaccaccattgaaatgctgtgaggcccaacaaaataatgcataggagagttagaaatccattataagaatcacatgaggagtgtttacttcagcagcacatatactaaaattggaatgatacagagaagactaacatggcccctgtgcaaggatgacacacaaattcatgaaggaattacacaaagaatgactagttacagatacaggacttgtattcattctgtcaggcaaatatgggaaacctcaaacatatttcttttggtttctaatttcaaaaattcctaatttgtgttaaaaatcctataatccagtgtgtgaagctatagctatttgctcttagtttataaatatgtaattatggactactgtgtcttggaacctaaccattatttataatgtttctatggaaaaatgcaataaggtaaattgctaaaagttggtgaaaataaaacctaactgtcctggagagaacttttcagagcaattaaatagaagaaacaggatttgtattattttgaacacaatctaataacaaaaaaatatttgcagggaaagcaagaagtttagatgctgtgtactaaatctttattacatgttgatgctaaagctagattatataacttagaaaatgccatttcctagggggttaaattatcaatttgtatttaagcttcatagttaatatctttttattgcagaacctgggtgaatccaacctccaggaattctgagtgagataacgaggcagtggaaacacttgaccctggagtctatgggtgtgaattatttgaaataaaaatcaactgacattctaaacattgtaaaggaccaaaatacattgtaattgagagttaggtgacttaccaatggttttttgagatagctctaaaaaaataaataaaagagaaaagaaatgaatagctgctctcagactctggagcccatagttctcatttacatgcttttcctggtaagaatctataccattaaacttggctcagctacaatggggtagtagcgatgttctttctcatggatgctaggacaatctgatacatataaggccttccttatgtgctggatctactgagaggccaagtagcaaaggtactaggtagagatcacccttttggcccatttaaacccctgtagaaaattggaaaaaccattctccatttaaacttaaatttcttccttttccccataatttcacttctttccatctcattctgtttttaaaagtcctttgtgtgatattgataagccaatggacacattcaagagttcatctttcactttatagtttgtgtttggcaatggaatgtatattcacactattaataatgacttactgaaatggtaggtagaagaaaacaaaaaggccaaaaaaaaaccatggactcccaagcccctgaaatcccaacatgaaatccagggaagggtccctaagatactgcagggagttaaaattctctacagtagagaatcagacagtaaacttactgataggtcccgtagctcctgctgagaaacagagtgaaagagagaggaagagggggagaggtgaagggagagacagattattactatgcttcatcactataagggaaataaccattcttcaacacttactctagagggagtgtcataagtagaaaccctaggtgcatcaagggttgcttacatggcaatcctcagacagattccctattggaccatataggagacttccaggaatggaggcatccccttgttttcagtgatatttgcaaactttagaggattggaataactccttccatactaattcataatgtctcctttaaattattttctctttttttcctctcatttcattagggacttattgttatttgaatagtgaacctattctatatgttggcaaattgaatttaaataaaatatttctaaaaaagtgaaccttcctttgctgacagggcataatgactgcttttctatttttttatgttagttcatgggctttgcagtctctttatttcatttggagattctttggaaaccttgtaataggaatactagagaaattgagaaacataaaacatggcagagtggtacttaagatcttctggtgagaaattaaaggaaccagagtggagaaacaaatttgatacttacgaattggtgctgtaaattgcactgaaatacaaagaaaaggaaaatcagtgtggtttgatatgagcagaatgctcatgccacaatattctttttaaagaaattatgaagcaactcgaccagagggagaattactactgcatatcagtagataattttagcaaagaagccctataaccctccctctagattacgtcatttggcattcactcagctgtctcaagggattgacactcccaggggtaggtgggatgtcagtccagttggcttttttcatcagcacacctcctttgtttttttcacgcttattctcttgcctttgctttgaatcaccagttctcctgtagctcttccttcagtttaggaaaagtctacgaacagttgttttaattatttttatcataagtaagagaattttttcgtgggttaatatttatttataattcatattattttaaatatgaattatttgggtttcccttgtcttaaactcagtgacagttcagagtgttttctttcttttttttttttctgatgccttgggcatcaggaggtgtcagtaattcaaatgcaatcaagaagtgtgggtgagacatcctggaaatggaaagagcttgggtaaggagaggtcccatatcccatagaagaccaaagagtgcaaaattaggaaacagaaaaggaactcacttatgggtccaatggctccagctaaaatatgggaaaagcaaggcagactaattagaatggttctttggcacagaaaatttacagtttgcattgaaagtatttttgggaaaacatcataaatacagacacaggaacaaaatttctacttcatcggaggaggaaataaattcttttcttcattctccatcctggaagacccttgtaactactgggatctgacagctggagctgcagggatgcagtagtcagggttccttccctggtgggtcactgtttgtaactgcggattccacagaccattgccttttttccaacagggctaatttgaacttgtttaatcagaatctatggtctcgtcttctgaaggaggcagtgggaatttctgtctccagtgggtgactttggctcccttagtcatcatagtaacttggcctgcaatatcttagcataaaagggatagaaactctcagatggctcaagactctcatagatgcagttagtgggtaaaaggattgaggcactagacctacatgtttagcaataatagcccttctcctttacaaacacacatacacacagacacttctctgtacctcttggggtacatgtgctttagtgacacttccccagtgtttactcttggttgacttttgattattttaatcatgtttcatgtgtacaaatgctccaggaagagtagatacagggtgtgatctgtcatgagccctaaccctcaaatcattcttcttcttcctttagtattggccctgccccaggagctcaagctctgaatatcttcagcagtgatggatagaaatatgttaagaaatgaatgaaaccttggtaaatttcacttttcttgtcatcggatttaaggctactcttcctgtagagaatctgaaagggatggaggaggtgcttaaatcttagagctagtgcactcaacttatttcttctctaggtatggaggatagaaaccctgtagagtaatggttctaaaccacccggggatcttcttaaaaatgcagattctgatttagtgggtgttaggtgaagattcttcacttcttagaaactccaaggtgatgctaatgtggatccttggactaacgttaagcagcaggccattaagagactggtaaaatctcaaagcatttataggtcactgtttccatttatcttttttttttcttttctgtatcaagtgactctcactcagccctcattcccagtttttctgccagagatgtttgttgtaatatcatttttctatatgaacacttcttccagacttaatctttgttactagcagggcttatacattccacacaaccatcaacagcagtctggggacccttagtcagtgagctaggactcactgctcttccttgcaagtgtgactgagatttctagcaagggatctttctacccttctaacacttttattcttaatacttttcttttggccattgaatctcaagactttgagagatttaaaagtgatagtactttctcaggaaggctccagcttattaaaataagaatagagaataaaggaggagaaaataattgacaatttgtgaataggagagtcttacatattctaacagtgctgtaaagcaaagcacgtgggaattaaagcacagaaaagaaacttacttatgggtcctgcagtgccagctaaaatataaacacaaacaggtaagtctggcaagaacatgactgaaggatgtacatttcagggagcttcaggtcaagcatttactacatattacatttacatggaaagcagtaagagggtaagtctgcatccccctcccctccccttttttccttaagagactcataagatcttatttcctgaaattatttttcttgttctcaatttttactatcttcatactgtgaaatccttttaaaagtttctgtttgtttttggtaaacaacttcatccaaccataggatttttcctttcacctgttaattttattagcagagtttatactttgctaaataaaaaaattatcagttacttagagggatcctgaaatcagcctccagttcctcacactgataaaggaaaaggagaacagtataatagtgagttgtctccttccctcctcttttatgtgcctataaaccctaccccagcacttggtagaagctaaaaaaacaaaaaacaaacaaacaaacaaacaaaaaaaacaaaaacaaaaacaaaaacaaaacagttgagaaataggagaaacttacataaaggttctggagttgctttgaaggtttttgcatcacctataatgaaaagaaaattgataagaactatgagagacaaatattgtgtaagcaaaaaaaaaaaaaaaaaaaaagacaaatataatctcatctagatctagactttcagagagcatgaagtgtaggcaatttcattctgtccacccatgtgtgcggtacaaatagtcttgagattaaagatcccaagactaggggcacctggatggctcagttggttaagtgtccaactcttaatcttgatcttgagatcaagccccatgttgggctgagtgtgaagcctgcttaagattctctttctccctctccctgtgccccttcctgctctctctctctttaaataaataaataaataaataaataaataaataaataaatatccaagatcggagagtcctactttgctagtctctagttttatgactatgtaagtcactaaacctttggaacactacttttctcatttttaaaatggacatgagggcagcccgggtggctcagtagtttagcgccaccttcagtccagggcctgatcacgactccggggatctagtcccgcatccctgcttggagcctgcttctccctctgcctgtgtttctgcctctctctctctctctctctttctctgtctcatgaatgaataaataaaatcttaaaaaaataaaatggacatgatacctcctttcttggaggcataacggcagtgaaaaatcaagaatgataatgaataggaaagctaactaagttctatcaaaattgttatgaaaagaaatatttggtgactataaaagaatgaaactcttctgtaaagtaggaagtttttactgtgtctaaagtattcagcttcagtttactttttttctaccttctctatttttccctcttatatctttttgtcatttggaaagttctgagtgctggtgacagggcattttcttgagcatttcattctattgtcttggtttgctgatctgtgtgatttcactcttttaaaaaaaatctttttgtgttccttagttacctcagtaccttagttatacgcattgcccttgcagtgagattggcagtggtggtgaaccattgctcctttcttgagagtaatcaatcttattttaagacctgaaaagcctctttactgaaacaagtgtatagatgaattaattttcacatggaatttcaaaagttttgtgtatgtgtgaagttgtgatttgaagtttacaatctacttttttttttattttaaagattttatttatttattcatgatagttacacagagagagacagagaggcagagacacaggcagagggagaagcaggctccatgcagggagcccgacgtgggattcgatcccaggcctccaggatcgcgccctgggccaaaggcaggcgccaaaccgctgcgccacccagggatccctacaatctacttttgacttccattttcctgttctggagatttttactgaaattctttccccctcttgctttccccctcaactctttcttttttttttttttttttttttaactctttcttcttttacctgttcagatttttttccttatttagtttatttctctgttgaacactttaagtgttgaagtattgttttttaaaaaattatatttagtgagagtttagtgagttgaaaaatttgctattgtttctcttaaaataattaaatttagtttatacttgtctatttatgacttggtgtttgctagtttgttgtgtttttggggaaatagcagcttttcacagaaatgacaagatctcagcacttgaaaggagatagttcctcttctatgtgttatagactaaggtaacatactgccattcccactaccaaataaagataatttacaaaacccagctctcatatacttaagatttaagaatattgaccaatattaccaggaatgatgaatatagtttagttaatgtgctaattctgatcaattagtagcaactccctggagaggagaagaattttagattgtattactggtatttgccactggcaaaggtgagcagaagaggaacatatggtatgtttttggaagtttttgaacagagagttttgtggctttgcccagttgaagacaaataatcatgacagtgaaagatttccatttactttcaaagtaaagaaacagataaaaaacttaattataagactcgagcatcctgccaaaatactaagtattatgtataaacataataagattaagatatagattaaggacatagcttctgtggatagtctgcctaatgaaaatatcagaattagttctcttagagagtaccaaattttccattactaaatggaaatactggttgtctttattgcctcagcaggtctcgtgaattgtgaacctgttggctataggagatactggggaagttgagcatttgaaaagtgcacaccctctctagaagcattcaaattcaaaatttaaaataacgtgatgttggtctcctggaacacatgtgtggatggcaatgggctaatgaactgccaacttgggagctctactctgaaaaaggaagagatttaagtgagcaccctacatacttcaacagcagtacaatgtgagatttgcatcaccaccaactgtggcctggcttgagatagaccaaatgaataccttttttcattaatttaatcataggtattggctgggtcacatttaattaaaccctgtaattctacaaactagttcaggttgtgaagcacctggagtaatttttagatacttttagagaaaattatgaaataatgatctttgagcaagaagtaattttaatcattgtaagaatgaccaaaaatataatattcagtgtgaaaaattttatcagaaacacatagctcagaagaaaaaaatctgtcaactagaattacctcttcctaaatttttaatttttttttgtatcactttccgtaattccttacttttctgcccctcattcctctttcaatcttccctttgtttagaaaatgtggtcattttgctttcgcaataaatggaaatcagttccaggagacagatttaagcttcttcacctcaatttttcttctttctctattcatgctttctacaacccctcacttttctgttctgttctgttttacaactggtagttgaaattagttataaaagcttaatgagaaattaaataatttgcttatgttcaaagacgcagtacatagggagctggcatacaactccaggcagcctagctccagagcatgcatctgcaacagtctctttgtatatttataatacattaattaacaagtaaacttatttttaaagtggttcttaatagttcttattataccactctcaattcatggggacataatgcttattttcaataatgaggtgaacagtaatttattcccaagcacacagccaaagtaaaccatataatttctttctttgtgggtgtgtgtgggggtgatgtagttagagagggacacagagtccaaggagaaactgttgggatggaagaaaaccaaacctgctctgtactcgaaggagagggagttaatggaagaggaaaaatcaaagctatagaagagaagaagctatgactgctgaagagaaggtggggcagggagataaggtcccatgacatgacatgagtgcagggatttgcttgaaaccaagaaggggtgtttcattgtcttagggagaaactgtgacaggtgagcatgttgtcagtaagataactaatgaaggagaaggtgaagaacgatgagcctcaagcgctgttactttgacatagcagggaccagacaaggcagggagacgtcctctgcctagtgtaggggccctataataccagattttgaaagaagaaaaacttacctatggatccttgcagtaatgctaaagaacaataacaaatattcaaataagtttagagttgatggtttaagtaatccacccatttcccaagagtctttcctgaaattgtaccctccattccccagaaggcacatgggttaccagacttgcaggtctcaaatcttcctcccccttgggcactatctaggagtgaaattctcaggagagtctcaaggtttactgtattttcaatattctgatttcattcagcacctctcttttcccctatttccaatctcccctctttcttttctcttcttattttggagaatctcctttccataatgtaacagcttcaagaaacagagaaaggcaatattagaaagattctaattttataataaaagactgaggctgagagaggggaaggtctgtgcctgagcatgttaaaaaaatatatgcagttttcaccttcaatttttctgattcaaagttcagtgcactttctcctgtatcccatacgtttttctccttccgttctttctggaatactcctttagaagtaaatttctttcctatatatcgactctctctctctctggttctttttattaatctctggaatgttcctctttaaagtgtcttaagtaataggaaaggtttgtggaacttttagtattattaaatcatgacaggattatcagtatgtagctactatagaatgaaccccactatattcagtggaagaaagctgagcatttgtcttatttgccttatgttggaggttaaattcctgtgtgaagtctgatcttagatcattttcaccatcttctggaaccttatttaactaatctctaaaagaacagggtttaacaatgctctgttcagctcaacttttaataattcatttagtctaaatccacaaactgaagtcctgtattcctctgcctttcatccttagctgatagaatgtaggataacagaaaagcaaaaaggctgacattctaaatttagggcctgcccaggaaaggtcagacagggaaaacaaggtcccagatatcaaggattcatggcagagaaacaactagaaatatgctcaattcccttataaactgtgttagttgaacacacagataaattcatgaggtcgattgcttaaatgcatcagagttaatcccctttgaagaaaagcttcaggaagaagctttcacactgccctcctctgtgattttggtcacagatagtgtacggatacagtacatttgtgctgcgacagaggaggactggtgatgagcagggaagccatttactttttctttgtaaaggttgaaactctttaagggaactttgaagacaataagtcttggttaaactttcgttagttgtcctatgtacttctttctttttacctcctgcttactctctttttcctgaattgagaaatagaaaagagacttaaatactgttcctggagttgacactgaggaataatggcaaaaatccacaggaatctggattaattggtttaaaaagcatataattctcacggaactagaaaggaggtcctgattagtcttctgaagtacagtgggtgaccagatatttgaatcccagttcctctgattaatagctatgttaccttgcataagtcatttaattttttgtgcctgagattattcattttaaatacaagatttataataatatctatttcataggatttctgtgaagatgtaaagtgcttaggacagagcctggaaacatactccatacatattattataacattgtttcaaattgcaatccttatctatgtatacctgtgtatacctgcatgggggagatggaccataacctcctttgcctcagacactgtgttggtttaagatttttaaagaaataatagaatcaagcccttcgttctcctggtgtgagagcccttccccaagttaccatagtccactgagatgcttctgagaatggcctctcaagagagcctcattcatcctctaggaccacacaggatattaaacttcggagtgaatggccccatacatctctcacctaaacattatgtataacaactaattactcaccttcctctgagattaatttcagtatgtgtcacatatccatttaccttattcaccattaggggataaatctcatcttaaggagcatattatcataatgattagcatagctcctagtctgattttctttcttaccctctaatatccagcacaccatgctgtctggaattcatatcagcaaattctcccatatctttaagttctccacatgttctcttcattattttgttttagtaagcccaattgtcctttaaagtactatgtctcttgcagccctctgaggaatggctatttttttttatctcatactcatgtaccacagggcctgcaaatattgcaggagaaattaaagatctgagtttattatttagcacatgtcaacctgaagatattttactctgttcctatcataaattatccttctgtaacttaattgaattaaaaaaagcaaaacaaaataaaaactctgttgattataacagtaataaaatattgagcctgatagttttccaaggttatcttcaagatgtatatatatattttttcttacatatacatattatgtatctatgtaataaaacagcctattcatcagatgcagttttgacacagtatcagactggcaaaataattttgagatttatattaattcacatttttttgcatttttgaatttcatattaaaaattgaagtaatatcttttgcatatgcataatgtcctaaatttcttgaaactttttttcaggaagatactttaaattgaaaaattaaatatttttaatggtgtcctggggatagttggacaagcacaggatactcaaaagctcggtgtttagaaacctcagtttttcattctatgaactatgtgcctttgggtaagttagacaatatcctcaatgtcacttttcttacctgtaataactgtaaatatggactcaacaaacatggcttctttaattacagttctcctttactcttattccctgcccttttcacaaacttcttccttccttcctcctgcttctgagtcaaagaagatatttggttttgctgaaactatcatagccagctaaaaccatttgaatcttatcttcatttgtaatcagtggacttttcattaacttcagataaaatgttcgatgatgagaaggaagaaaagatgaaggacaaggctaggcagagttaaggcacaaagggaatcagatttgagaaagagaaaaaaaacttacctctttgttctcctgaaaagaaacacaaaaaaggttatgtggttgtctggcatttttttgttgctttttttttttttcatttttggagtatcagaacagggtatccctggaagcactaacccctgagtgtcagtcaaggctcagggaggtagagcattaaacacctcctccattgttaccattcaaaccctggaacaccttgaattgaattgggggaaactaaaggaacttaccaatacttgatcgagacagtgctaaaagaaaacaaacaaaaatgagatttttgtgcttcagggagaacctaaaattccatagctactatatgaggaaaaggttgtgggaaagaggacagcaatgggtcacattccattttctattatcaggtgcaatgcaatgtggagggctgatggatatccagttacagattggggtataaattttaggtttttgtataattctacagtaattctgatagggcagggtaggattacaaaacctatgcaatttattttttaagatctcttagtaagataataacaatgtttatgagaattgctagtttcttagtccatggaaacttttcttcctcctgtgacttttgtctttccttatcctgctgcttttgttctttttgttttctttctctacttaccttcctcctcttcttctctctctattttgtttctcttttttcccctttgtttgaaagatcttttgtcccaaaagatctactacataagagcttcaacagggggtttctacttctcaaaagtcattgggtcctataaggatactcaataacaagaaaacaaaatcaggatgctcctagatattaaaagatagagtcaaggcagataaaaggggcttgttgtcaagatggatattcaccctctcctctatttacttggaaaagttgggcttaataatttttaaagttttatttttattttttaaaagatttttattcatgggagacagagagagataggtagagacacaggcagagggagaagcaggctccccacgaggagcctgttgtaggactggatcctgtgaccctggaatcacaccctgagcggaaggcagatgctcaaccactgtgccacccaggtgcctcaatttttaaagttttaaaacataaaactgaacttgagacctaggaagggaagtctccaaggaccatctatcaagaaggaagccatcatctatatatcttaaaggaaggttcatcacccatatatcttaatgggaggttggcttttcaacacatgatcaggagcaaaaattaaggccataggtctcatgcaatggaagaacctggaactaattgttctgtatatctcacaaaagcactatctgtgaaattggaaccattcatatctgtttgtcagggtttgccaggaagtgatctatttgcaccaggctatggctggaaattgagtctccagcaatgaatagaactctcattgtaagccaagttcaggtatagggcccacatttgaacctctcatataggggagaaactgaattaataggattgttgcacaataggaagtttatgaggaactcaaacaaatgacaactaatgaacttacagatataagttgaaacacatttaaggaaatctactgcagtgatagatgccacaacaaatgagactacacatataaaaagaaggattcaaagggaatttcaaacaagtgtttttcacatattcaaagatatgaaagaaggactagaatccataaagcaaaaacagcattaatcaggaccaactatatttgacaaagaacaaaatgaaagcagatgtagaaaatagagtcattatattataaatcattaggtgggtaaacaaagagaataggtgtaactgaagaaataattcacaaatggtaaatctaagggaaatcatccaggactcaatatcaagaaataaagagacagtatgacaaagttcaccgtgttgtttaccaaagtaacttcttttttctccaaggcatatgtgtggtagatagaagaatctctcccctaaatgtccacatcctaatccctatccctggaacctgaatatgttaggctacatggcaaaagggatctaaggttgcagatggaactaaggttgctaactagctgaacttaaatagagattttatcctggattatctgtgtggactcagtggaatcataagggtctttaaaaatggaagctggctcaagaaacaaacagtcaatacccaaacaatcaatacccatacccaagaaacaaacaatccagtcatgaaatgggcaaaagacatggacagaaatttcaccaaagaaggcatacacatggccaacaaacacatgagaaaatgctccgcatcacttgtcatcagggaaatacaaatcaaaaccacaatgagatcccacctcacaccagtgagaatggtttaaaatgaacaagacaggaaacaacaaatgttgggagaagatgtgcagaaaggggaactctcttgcactgtgggtgggaatgcaaactggtgtagccactctggaaaacagtgtggagtttcctcaagaagttaaaaatagagctaccctatgacccagcaattgcactactgggtatttaccccaaagatactgatgtagtgacacatggggacatctgcactccaatgttcatagcaggaatgtccacaatagccaaactgtggaaggagccactatgcccttcaagagatgaatatatatatgaatattactcagccttaagaaaagacgaatacccaccatttgcttcgacatggttggaactggagggtattatgctgagtgaaataagtcaaccagagaaggacaatcatcataaggttgcacccaatacatggaatataagaaatagtgaaagggtgatggacactaaggagacacttgttggggtgagcactaggtgttatactatatgttagcaaattgaatttaaattaaaatatttatttagagagggaatccctgggttgctcagtggtttggcgcctgccttcggcccagggcgtgatcctggagtcccaggatcaagtcccacatcaggttccctgtatggagcctgcttctccctctgcctgtgtctctgcctctctctctctctctgtctctcatgaataaataaataaaatctttaaaaaatatatatttatttagacttaaaaaaaatggaagctggagattgaaaggagtcacagaaaaagatgtgaccatggaagaaggccagagtgatgtgtatgggaagcttagtcaatttttgttagttttgaagatggaggatgggggaccatgtgccaaggaatatccagaaactgaaaaagcaaggagactgctttgttttcagaatttccaaaagaaacacagtcctgctgccactttgattttagcccagagagacatgtgtcagatttctaacctatagggacacctgggtgcttcagtgattgagcatctgacttcgcctcagggcatgattctggagtcctgggatctagacctgcatcaggctctctgcaggaagtcttgttctccctctgcctatgcctctgcctctctctgtctctcatgagtaaataaaattaaaaaaaaaatttctaacctatgaaattaaaataatatatttgtatcattttaagccattaggtttttggtatttggttacagtagcaatagaaaactaatgcaatatggtttgactgtttcctctgcagttaggggaactatatgagcgagttctagcaaatctaatcttgaaagagctatgtgaaataacacccaggcttccccataaaagccttgaactcatgatcttctcctgaactctgcctgtgtcagaagccattagttgaagttggtggagacataggacaagatgaacttacgtgcttaagtcattgctgagaggaaggccaactaccaatcaggcatccctgatttcacataataatataattttgtgaatagaaccacagagattttaagatttatcgattatagggtcacagactgatgtaattaataaaaatgagatagacaaaggaaaaattattagtcttggaagatgagaggggaacctttacatatatttgatagttatcttagaaggagagactatgacttgttaggtggatagatatagacataagtataaaaatggaatatattcatagcagttaatgtcaagaattttctgtaaacaaagacaggagtccacagaatggaaaatcttgagtcctgagcaagataaatgaagttaacctcatacccagttacatcataattacaatgaagaatgcaagaaaaagggaaaatattaaaatcatagatcattatcaacaataaaaagtgccagaaaaaaatgaaataaatcttcaaaatcttgagagaaaaaaatgttaactattactcagctaaactctcatttaaggctgagggtgaagtaaagctattttcagtcagacaagggcttagaaaaacgttcacatgcacgtggagccataagaagagcaaaagggatgggatccctgggtggcgcagcggtttagcgcctgcctttggcccagggcacgatcctggagacccgggatcgaatcccacatcgggctcccggtgcatggagcctgtttctccctctgcctgtgtctctgcctctctcgctctctctgtgtgactatcataaataaaaattaaaaaaaaaaaaaaaaaaaaaaaaaagaagagcaaaaggggaggaggggcaagatggcagaagagtagggtccccaagtcactcgtccccaccaaattacctagataagcttcaaatcatcctgaaaatctacgaattcggcctgagatttaaagagagaccagctggaatgctacagtgagaatcgcgcttctatcaaggtaggaagatggggaaaaagaaataaagaaacaaaaggcctccaagggggaggggccccgcaaggagccgggctgaggccggggcgagtgtccccaggacaggaggagtgtcctcccggaggagcaggagctgcacccaccttcccgggggaaaggggcccgcggggaggtggagcaggacccaggagggcggggatgccctcgggctcccggggacactaacaggcacctgcgccccaggagagtgcgccgagctccctaagggctgcagcgggcacgcggggacccggagcagctcgggtgggctcggggcggctccgcggagggggctgcggggcgggagcagctcggggggctccggggcggctccgcggagggggctgcggggcgggagcagctctgggggctccggggcggctccgcggagggggctgaagggcgggattgagaatccaatagcacaggtccggagcacaaggcgccgggacacagcccaggatccggcctccaccgggaaagggagaggccgggagggcccaggaccccaaggacactcctgccccgagctgagcagatcagcggccccgccccggagcctccaggccctgtagaccgagagctccggagttactgcgggggctgactccagggctccagatctggccccgccactgcggttgttcctcctggggcctcacggggtaaacaacccccactgagccctgcaccaggcaggggcagagcagctcccccaagggctaacacctgaaaatcagcacagcaggcccctcccccagaagaccaactagacggacaagttccaggggaagtcaagggacttaaagatacagaatcagaagatactcccctgtgtttgttttgttgttgttgttttgtttgctttttgatttgtttccttcccctaccctttttttcctttctttttcttttttttttctttttttattccttttttctttttctctcttctttccttctttctctcctctctttttctccttttcccaatacaacttgcttttggccaatctgcactgagcaaaatgactagaaggaaaacctcacctcaaaagaaacaatcagaaacagtcctctctcccacagagttacaaaatctggattacaattcaatgtcagaaagccaattcagaagcactattatacagctactggtggctctagaagaaagcataaaggactcaagaaacttcatgacagcagaatttagagctaatcaggcagaaattaaaaatcaattgaatgagatgcaatccaaactagaagtcctaacgaccagggttaacgaggtggaagaacaagtgagtgacatagaagacaagttgatggcaaagagggaaactgaggaaaaaagagacaattaaaaaaccatgaagatagattaagggaaataaacgacagcctgaggaagaaaaacctacgtttaattggggttcccaagggcgctgaaagggccagagggccagaatatgtatttgaacaaatcctagctgaaaactttcctaatctgggaagggaaacaggcattcagatccaggaaatcgagagatccccccctaaaatcaataaaaaccgttcaacacctcgacatttaatagtgaagcttgcaaattccaaagataaagagaagatccttaaagcagcaagagacaagaaatacctgacttttatggggaggagtattaggataacagcagacctctccacagggacctggcaggccagaaagggctggcaggatatattcagggtcctaaatgagaagaacatgcaaccaagaatactttgtccagcaaggctctcattcaaaatggaaggagagataaagagcttccaagacaggaaggaactgaaagaatatgagacctccaaaccagctctgcaagaaattttaagggggactcttaaaattcccctttaagaagaagttcagtgaaataatccacaaaaacaaggactgaatagatatcatggtgacactaaactcatatctctcaatagtacctctgaacgtaaacgggcttaatgaccccatcaaaaggcgcagggtttcagactggataaaaaagcaggacccatctatttgctctctataagagactcattttagacagaaggacacctacagcctgaaaataaaaggttggagaaccatttaccattcaaatggtcctcaaaagaaagcaggggcagccatccttatatcagataaactaaaatttaccccgaagactgtagtgagagacgaagaggaacactatctcatacttaaaggttctatccaacaagaggacataacaatcctcaatatatatgccccgaatatgggggctgccaaatatatcaatcagttaataaccaaagtgaagaaatacttagataataatacacttatacttggtgacttcaatctagctctttctaccctcaataggtcttctaagcacaacatctccaaagaaacgagagctttaaatgatacactggaccagatggatttcacagatatctacagaactttacatccaaactcaactgaatacacattcttctcaaatgcacatggaactttctccagaatagaccacatactgggtcacaaatcgggtcttaaccgataccaaaagattgggatcgtcccctgcatattctcagaccataatgccttgaaattagaactaaatcacagcaagaactttggaaggacacaaaacacatggaggttaaggaccatcctgctaaaagatgaaagggtcaaccaggaaattaaggatgaattaaaaagattcatggaaactaatgagaatgaagatacaaccattcaaaatctttgggatgcagcaaaagcagtcttaagggggaaatacatcgcaatacaaacatccattcaaaaactggaaagaactcaaatacaaaagctaaccttacacataaaggagctagagaaaaaaacagcaaatatatcctacacccagcagaagaagagagttaataaagattcgagcagaactcaatgaaatcgagaccagaagaactgtggaacagatcaacagaaccaggagttggttctttgaaagaattaataagatagataaaccattagccagccttattaaaaagaagagagagaagactcaaattaataaaatcatgaatgagaaaggtgagatcactaccaacaccaaggaaatacaaacggttttaaaaacacattatgaactgctatacgccaataaattaggcaatctagaagaaatggacacattcctggaaagccacaaactaccaaaactggaacaggaagaaatagaaaacctgaacaggccaataaccagggaggaaattgaagcagtcatcaaaaacctcccaagacacaagagtccagggccagatggcttcccaggggaattctatcaaacgtttaaagaagaaaccatacctattctactaaatctgtttggaaagatagaaagagatggagtacttccaaattagttctatgaggccagcaccaccttaattccaaaaccagacaaagaccccaccaaaaaggataattacagaccaatatccctgatgaacatggatgcaaaaattctcaacaagatactagccaataggatccaacaatacattaagaaaattattcaccatgaccaagtaggatttatccccgggacacaaggctggttcaacactcgtaaaacaatcagtgtgattcatcatatcagcaagagaaaaatcaagaaccatatgatcctctcattagatgcagagaatgcatttgacaaaatacagcatccatttctgatcaaaactctacagagcgtagggatagagggaacattcctcaacatcttaaaagccatctacgaaaagcccacagcaaatatcattctcaatgggaaagcgctgggagcctttcccctaagatcaggaacaagaccggatgtccactctcaccactgctattcaacatagtactggaagtcctagcctcagcaatcagacaacaaaaagacattaaaggcattcaaattggcaaagaagaagtcaaactctctctcttcgccgatgacatgatactctacatagaaaacccaaaagtctccaccccaagattgctagaactcatacagcaatttggtagcgtggcagaatacaaaatcaatgcccagaaatcagtggcatttctatacactaacaatgagactgaagaaagataaattaaggactcaatcccatttacaattgcacccaaaagcagaataaacctaaccaaagaggtaaaggatctataccctaaaaactatagaacacttctgaaagaatttgaggaagacacaaagagatggaaaaatattccatgctcatgcattggaagaattaatattgtgaaaatgtcaaggttacccagggcaatttacacgtttaatgcaatccctatcaaaataccatggactttcttcagagagttagaacaaattattttaagatttgtgtggaatcagaaaagaccctgaatagccaggggaattttaaaaaagaataccaagggatccctgggaggcgtagcggtttggcgcctgcctttggcccagggcgcaatcctggagacccgggatcgaatcccacgtcgggctcccggtgcatggagtctgcttctccctctgcctgtgtctctgcctctctctctctctctctgtgtgtgactatcataaataaataaaaataaaaaaaaaataaaaaagaataccgtagctgggggcatcacaatgccagatttcaggttgtactacaaagctgtggtcatcaagacagtgtggtactggcacaaaaacagacacatagatcaatggaacagaatagagaatccagaagtggaccctgaactttatggtcaagtattattcgataaagggggaaagactatccattggaagaaagacagtctcttcaataaatggtgctgggcaaattggacatccacatgcagaagaatgaaactagaccagtctctttcaccatacacaaagataaactcaaaatggatgaaagatctaaatgtgaggcaagattccatcaaaatcctagacaagaacacaggcaacaccctttttgaacttgaccacagtaacttcttgcaagatacattcatgaagtcaaaagaaacaaaaggttcctcaaagagttaaaaatagaccagccctaccacccagcaattgcactgctggggatttaccccaaagatacagatgcaatgaaacgccgggacacctgcaccccgatgtttctagcagcaatgtccacaatagccaaactgtggaaggagcctcggtgtccatcgaaagatgaatgggtaaagatgatgtggtttatatatacaatggaatattcctcagccattagaaacgacgatacccaccatttgcttcgacgtggatggaactggagggtattatgctgagtgaagtaagtcaatcggagaaggacaaacattatatgttctcattcatttggggaatataaataatagtgaaagggaatataagggaagggagaagaagtgtgtgggaaatatgagaaagggagacagaacgtaaagactcctaactctgggaaatgaactaggggtggtagaaggggaggagggcggggggtgggagtgaatgggtgatgggccctgggggttaatctgtatgttggtaaattgaacaccaataaaaaataaataaaaaaataagtaaaataaaaaaataacaaaaaagaataacaaaaggactatacttgggtaagaagagagaaaaggacacaggatatagcaaacaatcataagaagacaaaatgctgatacatttttataaatctattactataaataagtaaacaattatttttgttcttgaaagtcatactatgaaacaacatggaagatgttgaaagggaagatagtcaaaagaggttattgtctagtcttagaggaagaataatatactgattaggttttgttttttttttttttagaaaaatcaagtggtatgaatgttataaatgttaaggacagctttttcgcaacgggtttgccgccagaacacaggtgtcgtgaaatcaccgctaaacctaaaccaaaatgggaaaggagaagactcacatcaacatcgtcgtcattggacacgtagattcgggcaagtctaccactactggccatctgatctacaaatgtggtgggatcgacaagagaactatcgaaaaatttgagaaggaggctgctgagatgggaaaaggctccttcaagtatgcctgggtcttggataaactgaaagctgaacgtgaacgtggtatcaccattgatatctccctgtggaaattcgagaccagcaagtattatgtgaccatcattgatgccccaggacacagagactttatcaaaaacatgattacaggcacatctcaggctgaatgtgctgtcctgattgttgctgctggtgttggtgaatttgaagcaggtatctccaagaatgggcagacccgtgagcatgcccttctggcttacacactgggtgtaaaacaactaattgttggtgttaacaaaatggattccactgaaccaccctacagccagaagagatacgaggaaatcgttaaagaagtcagcacctacattaagaaaattggctacaaccccgacacagtagcatttgtgccaatttctggttggaatggtgacaacatgctggagccaagtgctaacatgccttggttcaagggatggaaagtcacctgtaaagatgggaatgccagcggaaccacactgcttgaagccctggattgcattctgccaccaagacgtctacaaaattggtggtattggtactgtcccagtgggtcgagtggagactggtgttcttaagcctggtatggtggtcacctttgctccagtcaatgttacaactgaagtaaagtctgttgaaatgcaccatgaagctttgagtgaggctcttcctggggacaatgtgggcttcaatgtcaagaacgtatctgtcaaagatgttcgttgtggcaacgtggctggtgacagcaaaaatgacccaccaatggaagcagctggcttcacggctcaggtgattatcctgaaccatccaggccaaatcagtgctggatatgcacctgtgctggattgtcacacagctcacattgcctgcaagtttgctgagctgaaggaaaagatagatcgtcgttctggaaagaagctggaagatggtcccaagttcttgaaatctggggatgctgccattgttgatatggttcctggcaaacctatgtgtgttgagagcttctctgactatcctcctctgggccgttttgctgttcgtgacatgagacagacggttgctgtgggtgtcatcaaagtagtggacaagaaggcagctggagctggcaaagtcaccaagtctgcccagaaagctcagaaggctaaatgaatattatccccaatacctgccaccccagttttaatcagtggtggaagaacggtctcagaactgtttgtgtcaattggccatttaagtttaatagtaaaagactggttaatgataacaatgcatcgtaaaaccttcagaaggaaaggagaatgttttgtgaaccatttgttttttttttttttttttttttttgtgcgtgcgtggcagttttaagttattagtttttaaaatcagtactttaaaaaaatgtaaaaaaaataaaataaaataaaatcagtactttttaatggaaacaacttgaccaaaaatctgtcacagaattttgagacccattaaaacaaaagtttaatgagaaaaaaataaataaataaatgtaaggacaaataatataaaagctaccaaaacaggtaaagcaaaacaaaaggaagaagaaaatttaacaatccaataaaaagtaggaaaaagatttaaaaaataaaagaataaaacatggtaaatagaaaacacagtaaaattggcagaactgaagtaaaatatatcagcaatttacaataaatgtaaaatggactaaagtctgaaacaaaattttataactgttaatgtgaacagagtcaagcaatatactatttttaaaaagacacaaataagaaaaaaacaagctgtaaggttgaaaataataggatataaaaatagttaataggaaaatacatattagaacaaaagttttgtagtaatactagtatcagataatgtagatgtagccaaaagtgttcatgagtctttggatggatatggtattattgtacaaagcgattttttaaaaaaagaacaattatatgttgaacttgtatatatctaaccagaatatggaaaggaaaaatgggaagtattaaaaagaaaaatgacatcaaaagtagacaattatagttagagacttaaacttagctgtctgaagctagtatataatgcaaaagaataacaatagagaacatttgaataataaagttaataagcttgggctgatagtacatctgtgaatagaatcttgaatccaaccaataaaaaatattttttgtaagtttacttacaaagcatcaaaagtctcaacacatttcaaagaacctaaatcacacacatcccacttttatatcataatacaattttaaatcaataataaaagtagaaaaactaacatacattaaactaaaacacactttctgtaatttatttgttaaaattatgggaattatgaaatgtttaaactgaaagtcaaagaaaatactatatatcaaagctttatgaaatgaggttttaatagcatttagaatgaacttaaatatttttattagaaaataagaaggtctgaaaattaatgaagggtttcacatagtaaattagaaaaaggaacaaaaatagaatgaaggaaatactagagataaaaacagaaactaataaaataggaaaagataattagtagatattttgcaaaaccaaaattgattttcagatagagtaataaataatagcaactatctttggcatcgatgatgatgatcaaagagagaaagaaggcacaagcccagtgatactaggaataaaaataggacatatccatagatagagtgaacaatttttagaatcataaaataatttcatgccattaaaaaccaaaaagcattaattaaaatatattcaatacttattcttaataagatttttgttagcaagctacaaatagaaattttctgaactccgtaaaagggaggtgccaaatggaagcaagcatcacatttaatggtgaaaccagaagtattcctgctaatgacagataccaagaaagattcctgtgattattgctggtattagtgctgggtattatggacagaaaaagtttgagagctggaaagaagactcaaaattgttagtttttgcagataggactttctgcatacaaaatccaagagaatctaaattattggaagtcttagagctcaacagggtggctagatacaaaatctactctcaacaataaaacatacaatttatacagcagcaatcattgtctgtaaaatccaacagaaaaaaacaccattcacaacagaaataaaaacaagtatgtgcataggaattaatctaacagaagatgctctagaccctttagagaaaattatagaacattattgaggagcatataagaagatttgaataatagatacattatcattttaatgcataggaagaattgattttataaatctacagacttggtgaaattctaaagaaatcttactgtgactcatacagatttaacaaatgaattgtaaaattttgtaagaatagaagcctaagaataggcaaagcatttctgaaaagaacaacaaagataaaaaaaaaatgtgccattcctcatgataaatgtcataaagctttagtaatggaagcaattttatatctgttgagcaaaagacaacagtttcctgaaaacagaagagaaaatccaggggaaaactaagtataagataaaagaggtattacaaatcaatgggtaaagaatgcataagtcaatgggacaattagttttccaaagagaattaaacccctctctatattatttataaacaagcaaaaaaaaaaaaatcccaaacgcaaaaacctccatttggattaacatcctgtctatatggacggagaaactttataactattaagagaaagtgtaggataacatttttgtaatatccagacaagaaaggccaaaaaacaaaacccccataaaaatcagtcggagaaggacaaacattatatgttctcattcatttggggaatctaaataatagtaaaagggaatataagggaagggagaagaaatgtgtgggaaatatcagaaagggagacagaacgtaaagactgctaactctgggaaacgaactaggggtggtagaaggggaggagggcggggggtgggagtgaatgggtgacgggcactgggtgttattctgtatgttagtaaattgaacaccaataaaaaataaattaaaaaaaatctaaatgaaaataaaagattggcaaatactacaactaattgtgggtgggtggggaggaggaagaatggggacttctaaatgtcaagagacaccataaaaatgtaaaagtaagagatagaattgcaaatatttgcaatatatgcaagagaagatatttgcaaatatataaaagactagctttcataattataaagaatttctaaaattcaataacctaatagataaatgggtaaactaaatgaagcctaagtaggtagtaaacatatgagaagatactcagtttcagtagtaagtgggaaagtgcaaattaaaaattttacactaagtggcaataatgtgaaaatatgacaaaatcagggttgttaataatgcaaggaaatgggaaacttttacacattttgatgtgcctcctatgtgaataccatggaattcaattaaatgacaactagtaaaataaaaatgtgtttaagttacataaatgttcatacgcattgagattaatcccatttcagtctgtgtaccttggataaactattttagaaactacataaggacattttgtagcattatttatgatagcagaaattagaaatattgagaacatgtcagtaggagaaagaatagaaaaaatatgttcacaaactgaaatttaacaattaaaatatgtaacctggttttctgtatactttcaatactacaatattttttttggaaaaagcaagttgtaatgatgcagaatagtgtcattttagtacaatttttacatgaatacatacaaaacaatactatatattgttcagtgatgcttagcaattatacaaatagatgaaaataaacttacaagatttatggtacatttttaagggcttgggcagtggggaaagtggaatgtgtggagggatgaggacgaaagggatttctatattatctgtcacttgagaaatatgacaaaaaatctatcaaatataagatgtgaatttacaagtgtctatttttgtactttaaaaacttctttgagagaaagaaaaagaaaaatacagaaaccacagagtgtgcaaaccagataggggaaaaaccataaggaacttacctagggagttggttgatggtgctaaaacacacacagagaaacatgaggtaaattgtcaggatttggatccttgacttgcatatcagtcagtcactgtgacctcctctcaggagttgcagcccaggcccagggcgacccactgacctggtggtgggcaccagaggccactcccaactccatcctttccatctatctaaaaggtttcagctttttagtagacagatgctattcctatgaaactccgtggcttacatttttctttgtcctcatcccttccccctcctttcctttcttttcctctccttttctcctcctttatttctatcacttcctttctctgtcacttatcattttcttttcttttcttttcttttttttttttttgcattcctctcagtcagtttggaaaccagcagaccaagtttggaaactgagtttgctaatggcagactatcctaaaccagtgctaggagactttctattacctagttttcatatgaactgatggtatgctctttcctcagagcatttacaatctagggaaatgttaccaatgggaagtaaattttcattgaaaaacaagagaatacttactgtaatctccttttgatccctctaaaacacaaataaatcaagaaaaatcagtttagattttctatttctgtagttttgatatcattacagaggattacccaattaacaccctcaaatatccaagtaggcaagaagctgcaggcaaaatcttctgatggactactttatgagtcaaatgacatgaaaaagtaagcaaaggttaacaaagggaaatatctagggagaaaaaataataaactatgcctggaaagaaacactgaagtggaagaacatgttagttataataagttgaggctaagtaagaggaaaaaaaggcaaatatttaatcagctgattgagaattcaagtttaatgaagagatggcaaattataatgaatacacacacctatatacatatacatacatacatatatagatatagatatgcatcctataacctaaaacttattttttagtgatgccatggaaacattttctaaaagatctggagagagacaaaggaaattatatgaaaactcatcatgctatcatttttattttcatgaaagtgtaaaaaccaacactctggaaatgacaaattatgttgcatgatggtctaatttgatattttactaaagtataagtaaaaatctacccagaaatgtaaagacaatattgttttctctcatcccctttctgaaaatgagttctttccttctatacctgagtatagaaatcttatcactgtgataagattaagtccaagacacaaaatcttctggtttacgctaatgttacttgtttctccaggctctgtcagtattttaaaaacagaaaataccgaaaggcgctgaacactttcatgtgctgtaattatatttgctgtaaaacttaataacattaaaaataaattcagtgcatttcaaaatttgtgaattatcatggcaactttaatctataacatgtgatatatttaaatactaaaacttaagtactaaattttatacacctaaacagacatgactttgctcaatatttttcctgtcagaagattgtagtctccagttgatttatatttatatttatttatatttatatttatatttatatttatatttatatttatatttatatttatatttatatatcctgaatgatagaagacagcctggtgagtttgggaacttagcaacaagatgactgagattcatagggccaccttagagtgggaaatcaaagaaatgagttgtcatttggctttatgaattttagattatggcttatttagatcacaaaaaatgcctactaatccaagttttccctaagaatgcaagggtagcctagaatagatggaactggaggttattatgctgagtgaaataagtcaatcggagaaggacaaacattatatgttctcatttatttgaggaatataaataatagtgaaagagaatagaagggaagggagaaaaaatgggtaggaaatatcagaaagggagacagaatataaagactcctaactccgggaaacgaactaggggtggtggaaggggaggagggcgggggtgtgggggggactgggtggcgggcactgaggggggcacttgacgggatgagcactgggtgttattctgtatgttggcaaattgaacaccaataaaaaataaatttattattaaaaaaaaaaaagaaagaaactaagattgcagactctacactaaagttccatagctggaaattagtaaggtattactaaatcgtgtaagaataaattatatgaaattagagtaagataattctaaacttctatcaggttgagtcacttgcaagccctgtggctttgggcttttttcatttttcttttttttttttttttttttcatttttcatgcttacatttctcttctgtaaattagggataataatgtatatagtacgttaattgatttaagaactgcttattaaggatcatccttactgataacaaaaataaactataagaaggcaagtataaagaaaccagttaggggtcaggtgaagtacttcaggcaagagatgttaatgcttgggctaagattgtcatcatggttaaaagtgatctaatttggaatataatttggaagtagtgggtatgggatttgatggtggattgtatgaggagagtgagagaaagaagttaaaggaatagatggcatgagcagttgggggaattcagatactactaccggtatgcagcaggattaggacttgggcttcggatgtgttaagagtgagatacccctcctctatcttcaggaccactgtattatgtttgtgtaggttggttgttgcacagagagatttggggactgaaatcccagcaatctttgagtagggctgcatctgcctagagagaggaatactctctaatttgcacgagagcaacctgtaggctaacctatagaggccttgaataaccacaggggcttttgggggtaattcattctatgtggttcacagggtcatttgtagatgttaaaataaaatgaaatgtccccaagagtggctagtacataagagatattgggtgcatttaattatctccctttcctgtcgtgtataattgcattttacttatctgtgtatccttacatttctcacattccgatagcttcttgcacttgtttaatgtaatgttgtaatgatgaattattctgagaagttttgttttcccaagaaacataagatgtaaatgacaacagtagaggaaagcagcccttgtttgtgctcttggaatttcagtacatgggtcgaatttcagtacatgtgatgaattttcagggattttacttaccttgatcatcataggaagcatctagaggattgaaggaaaaacataagattcttaatttctcataaatagatttctgtattaatttcttaaaaattcaacatctaatttatttaccactttctgttgaatacaaatgccggaatcctaaaagacaagattaaaacataatgagattctatcttgacaagtatgcctacgatatttactttttgggtgaaaatctgtttacctcttcttagatctctgagagggacaattttttgggggggaaaaaccagataaagtttattaacagctcatcaagcaatgtttaatcgtatgtctaaggccaactagcaggatttttctattttcccagatgttcccattttctttggattccatttcagaaaagagaggatgccacagctctttgctcctcactctgttggtcatgacagatgaattatagaagtaagaagaggaggtatacatgaagaggccaagtgtggggcatgacagcaagcaaagtgaccaagctgcttcctctctccttttagaaatacaaatctttatgcttgtaaagtgtgtgtgtatgtgtgtatctgtgtgtccctacaaaagaggagagtgctttggaatctacttagaaacattagatttctggactttttatttcaaattatcattatttttgagtcatgtcaaactacatgtcctgatttgattaatattaattaatttgattagtattagtaatgttaataataaatactgaaattcaattttaaaagagccttttttggtcttaaccaaatggtaatagtgtagtgtgagaatatgagtatagaactccgggccaccaacctggatatggatatatccaactcctttttttgctaggtgaatttggttaagtctcttaaacttttgcatacaatttcatctttttaaaagattttatttatttacttatgagagatacagaaagaagcagagacataggcagagggaggagaagcaggctccatgcaggaacctgatgcgggactcgatcccagaactctgggatcacatcccgagctgaaggtagatgcttaatcactgagccactcaggtgtctctcaatttcatcttctagaatgaagataataatataagttatgctcacctattgtgctttatagcttacagtgtcttttcatgtatactattcagtcttgatgacgacccatgaattatatactttatctctattttatatatctaggaaattgtttcagagaagtttcttagcctttccaagatcttggaaataggagctgtaaaattttttttaatgtcttaggatggggacatatttgccttttctgagaaaaatacacaaatctatcatctatctatccatttatctatacacacacatatatacacatacacacatagaaagatggattgacagttggatatgatcacagcaaaagatatgctgacttaacaaatcatgctcaaagggagatgagtttctttgttctctaaggaacacattcctccattaattctgtggtagctcctaatccccttacctctaccatcctcatagtccagaagaccagcacctggagaaaaaaggagagtgtgcttcatggttttgcttcttgaaaaggagagaggctttaagactgagagctaataatagaaatgaactctcagtaatgaataatgatgggaattattttactttgcaagaacgagggactgtgcacagtgggagcagataagtgactgtgccagtcaccagtttcactagacttaatagtaggtcagaagaggcctcaaattgatttccttcttggtactccaggatttagctcctgtttttcttttcttactaatcctggactatctttcagcaactttgatgtctcactagacattgccatagaaaatctgcatctcttaacatcttgaactcagtgttctcagtcataatcattttagttgttttcactcttattattcctggctatctttgattcttctacctagccaccttgctgaggccttcttcactaccagatttagaccttgtattccattgcttgtggtatctgctgtttttgtgacttggtatttctgttgctgctcttggaccacaggcagcatctgaagagagcctcagaatcatgcagacctatcccctattagattttttctgcccaatttcggtttggtactcagtattgcatagaaccctttggtggatttctctcagtaaattagaagttcagttcatgggatgatgcattatgcaaattgctggggatacaatggtaaacaagacagatttcaatcctggcttatggaaattccattatgctttctatctttgcttttttcatgagtcttaatacgtactttgttctgaactgtatcttgagacatcaatttctgtggaagaatgaagcaaaaatattgctattagctacttgtgagagttgttcttcctcctcacccaactcttctcactataaactctgcttctttgctcccaaggtggccctcttgatatgatatgttacagattcctacctcttttcagcacctccagctagtcctgttctacgggtacctccacactaattctctgagggctcataggtactgagatgagaaatagggaggggatgcagctgactagaagggagtggggaagatactgaggaaaatcctggaaagagagatcttgtggcatagaaatatgccattgtctacatgggccccatctctgtttgattgacaaatacttctctgtgtttgtctcttcttatcatctctgcagtattaagtcactaaaaatcttgaattcttttggtttaatactagctaacagtgtctactagcacagtgtcttgtcttttccatttttattgctcagatcatttcccttggagctcaagtgattttagaatattcttattactattgctaaattcaatctgcttttttggggggttgacattgttggtaatgagatttgggagttcaaaagtgcaagaggaatcactagtaagtcaaagattctttgattcatgtattgaaatagattcccataatattgacaaagtctctagatatctagtaagtagaaacaaactgtgactggatcttatatcccttccattgtggctttcacagaaaatttccatcttgacgtgttactcaccattttgcttgcgtcgtgtccatcttgttaataaaatagccagaatggcaagtcccaatagagtcaggatgacagccaaagttatttctgcaacaaaacttcacctgtaggcctgcttatttagacctggtcattatcagagacaacttctggttgcctcttaactgttttcaccaaatagacatttctcctctacccccttttctgctacctgaactcctttcttccctcatcttattgtcccctacccatttttttatgttgttctttttggtcagatactaagaatctcaactgctgtatatccttgatttagagtggaaaatgtggcagatttcctcctcaattggatcctttactctctgcaggcagaagattagaggaaaacagtaatacacaaaacaagccactgagaaaaaaaattagttctaacaatatcaaacatatattagtatactagtatgtaatatatatacaatatataatatatatacaaacatatgtttatatatatatgtatatatggaatgtgtgtgcaaatatagttacatgagtgagtgaccaaaaattttagaggctcctgactgaatgaagttggtcataataatgaaaaccatagcagaagacagaaatttcttaccattgggaaagaccttttagtcatcatgcacaaagccattcatgataagagttatttgtgatgactgttattttggttaatagaagaaagcatgctggaactgcctgaatgatatctgtgtatgtgtaattggagagacaaatcttaattagataccttgcaaaggttatgaagaactgagactaaggagcctttagaagaagaaaggcagacaggcagacaggcaggcaggagggagaaaaggaggaaggaagtggggaagaagggagggaaagagaaagagaagtaggaaggaaggaggaggaagggaggaatgaatgaatgaatgaacaaagctatcacaaatcttcccatgacagtgaaaaatggtgaagacaattgaactatgaagggctaagaaaattaattacaccaagattaagactgctgtcagtaagtgatagatgaattcacctcaggatgtaatgacacacctccaattggggaaaattgggcaaatgtctatcaaatctttcaggcgttagatcatgtgagaaaatttcctcaacaagtcagccttctgggattttctcctaatgaatcactaaaattaatagtaaatagtcggtttggcttctttcatgcaagtcagaatttcatcattgatgtgaaataattcttaggggaaagggataaccaggttgtgtacttggatcaagctctggtactccctttgagtagtgtctgaaatgcagtagctattggacagaagatgatccactccatttataaggaaaataagaggaagaattgaagcagattataaagtgaggagtattaccagaagtgagatagcaagttaaggaattttcctattattccagaggatggttattttcttttactaattcaaattcctgaaaccaaagggaaaatcagtgttctcactcttgagttgagttgactgtggattgttttccccagacttccagaaggatcagtgagagtgaaagaaaggatattgaatttgaaagaaagcagcaagtaaggtaaagcagtgtttcagtctctgaggataagacatctgagtcagtagtgtccagaaagccttagagagggagtcagtccatacccaagactgccattttccaggtatcgtcttcagtgggttctgtgtcatctggatttctttgtcagagggagatcaagataaacggaacactccaagctcactgtttctgagcagtatgaacttggatgtgggggaggcccttgtagataagcatgcagagggttgcagaggaactatatggctcaggttgatcagaccaaagcagactacaggagtgtggtctatgagggttccagaatctgtgtcataacaaagaactagaacttcagaggggcaagaagaaaggaagaggaggaccaagtggctgggaagatccagaatattttggaggactttaatcttatgattttggaagggaatctactctatctaagctctggaataagttctaactttccagacattttgaggccagagattgcgtttccatcatcttttacactgagatatgtgaaatcctccagccaaaaaaattgcagagtttctgactccagagctcacactctatttacaaagtcacatttcatttcaatcttgggggcctactgttcatgatagtctatagatgacatgccacttcagtaaacaccagggccctagcccataccagaactgtatgtcctgggtcatagaaaaaagccacagtttaaaagagcaactctaatataaaggaaccagccttagaatcctccaaatgggggtgcctaggtggttcagcggtttagtgcctgcctctggcccagggcctgatcctggagtcctgggatcgagtcccatatcaggcttcctgcatggagcctgcttcttcctctgcctatgtctctgcctccctccctctgtgtctttcatcaataagtaaataaaatcttttaaaaaatcctgccaagggatccctgggtggcgcagcggtttggcgcctgcctttggcccagggcacgatcctagagacccaggatcgaatcccacgtcgggctcccggtgcatggagcctgcttctccctctacctatgtctgcctttctctctgtgtgtgactatcataaataaataaaaattaaaaaaaagtcctgccaaatgatgagggagctgatgaatcttcctgggtcagaagggctccactggagcaccactgtttatgctccccctcctccttgatcttatagatgggagcaggatctggacatggtagccagcctaccatgtcagtgaacccagacctgtcacccctaccagccctagccatcccaccaaggtgtccccagatggtgcacactggaacacctctggtcagtgttcaccaaagctccaaccatcacatcaaggtgatatagatgcagatcaccctggaatattccagggctgcatcacgttggcttcagatagctctctaggctattcctagtgtagagtgttctcggacttcccagctaatgtctgctttggctctggctatcccctgcatggagcatcttgggaccccctggtctgcaccttgccttgtccagctattccaccacattcctgaactgaacactctaggaactccagcttgcatgcacttccaccaaagttgtcatgccctgtgtggaatgccctaaaactcactagcctttgtgctgcaccttggctccagccatcccactagggcatcatctctgtggagagtcctggaacaccttggtttatacccacttgaactccagctcttctgccaaggtgctttctctgcatagagccctaggaccttctagcttgcacccaatataactttatctgtccttccagggcatcctgtgtacagagagccaaaggactgcactggcttgcacccacttcatcttaggtgtcctaccaaggtgcccctgaatggagattcctcaggacatcctcgcccacactttcctctgttccagctgctccactaaggcactctctgtgaggagagccctgggacatcctagcttatatccacttcattctatctatcctgccaaagtgccctaaatgcgtactgccctgggccccccaccctgcatccacttcagcttcagttctcctccaaggacaatcaatcactgtgtagagagccctaggacatcctggcttgcacatgcttcagttcagctgtccttccagggcaccctctgtgcagagagcctcaggattgccccagaccatgtgcacttcagcttcagccatccaaccaaggcagccctattatggactgcccagtgacctccagcccataccagccataaccccagccagtcagcaaaaattgctaggcacacatagttcacacaggagatgaatatacacatgaccattctctcaagtttaggagaaataaccattccatttaatttgtagaaacaaacacagttaagcaaaatggagagacagaggaatatcccccaataaaaggacaagacaaaacctcagaaagagaactaaatgagatggacatcagcaatatgcctgacaaaagagtttaaagtaatgatcatgctcaccagactggagagaagaacaacagaatgcagaacttcaacaaagatagaaaatatgaaaaagaaccaatcagagttgaataatacaactgaactgaaaaaacacaccagacggaatcaactgtagattagagggtataggacaggtcagggatctggaagacagggtaatgtaaatcacccaagctgaacagcaaaagaaaaaaataactaaaaaagaataaggataggttaagggatgtcctaggcaatgccaagtgaacaaacattcacattatagcagtcccagaaggaaaagagagaaaggtgtagaaaacttatatggaaaaaatccaaaaccaatagaatacattatttgtaggtgaacatggaacattttccaggatgtatcacatgttaggtgacaaagtctcaataaatttaagaaggtttaaatcaaatattacatttctgactacaacattatgaaacatgaaataaatcacaagaaaaaaactcgaaaaaacaaacatggaggctaaacaacatgctactaaacaaccaataggtcaatgacaaagtcaaagaagaaattaagggaaaaatacatggagacaagtgaaaatgcaaatacaatggtttaaaatctttggaatgtaacaaaggagttctaaggggaagtttatagcactatagacctacttcagcgaacaagaaaaagctcaaataagcaatccaacctaatacctagaggaactagaaaaagaacagacaaaacccaaggtgagtagaaggagggaaataatacaatcagagcaaaaataaatgatatggagatgagagagagagagagaaagaaagaaagaaagaaagaaagaaagaaagaaagaaagagaaagaaagaaaaaggaaagaaagtatagaacagatcaatgaaatcaagagctggttctttgaaaagataaacaaaatcgataaacctttagccagacttattaagaataaaaaagaaaggacccaaataaacgaatcagaaatgaaatagaagcgataaccaataccatagaaaaacaattataagagactactacaaaaaactatatgtcaggaaattatacaacatataagaaatggacaaatttctagaaacatacgatctttcaaaaagtttaatcttcaggaagaaatagaaaatctgaacagaccagctactggtaaagaaattgaatccttaatctaaaaaactaccaacagggaggagggcggggggtgggggtaaatgggtgaggggcactgaggggggcatttgacgggaagagcactgggtattactctgtatgttggtatattgaacaccaataaaaaataaatttattataaaaaaattttaaaaactaccaacaaaaatccaccatcagatgtatgcaaggtgaattctaccacacatttaacgaagcattgatacctattctcctcacactattccaaaaaatagaagaggaaagaaatcttccagatatattctatgaaagcagctttactgtgataccaaaaccaaaataagaccataagaaagtaaacgatagtccaatgcatatagatgtaaacgatagttcctgatgcatatagatgcaaaaatcctcaacaaaatatttgcaaactgaatccagcagtaaatttaaaagatcatttgctacaaacagtttattccagggtttcaaggataggtcaatacttgaatcaatcaatgttatacattatatcaacaaaatgaagggtaaaaatcatatgatcatcttagaatggatggaataaaaaaataagaaataacaagttttggtgaggatgtggagaaaaagcatccttgtcaccttggtggggatgtaaaatgatacccactgtggaagatggtattgaggtttctcaaaaaaataaaaatagaattacaatatgattcagtaattctaccacttggtatttacccagggaaatgaaaacactaattcaaaaagatatatgtacccttatgtttattacagcattatttatcatagctaagatatgaaagcaacccaaatttccatcaagagataaatagatagggggggaggagcaagatggcggaagagtagggtcttcaaatcacctgtctccaccaaactacctagaaaaccttcaaattatcctgaaaatctatgaattcggcctgagatttaaagagacaccagctggaatgctacagtgagaagagttcgcgcttctatcaaggtaggaagacggggaaaaagaaataaagaaacaaaggcctccaagggggaggggcccgcgaggagccgggctgaggccggggcgagtgtccccaggacaggagagccccgtcccggaggagcaggagctgcaccgaccttcccgggggaaaggggctcgcagggagttggagcaggacccaggagggagcagatgccctcgggctccccgggacagtaacagcaactgcgcgcccaggagagtgcgccgagctccctaagggctgcagcgcgcacggcgggacccggcgggacccggagcagctgaaggggctcgggtggcggctccgcggagggagctgcgcggccccgggagcagctcggaggggctcgggcagaggaagaggctccgcggagggggctgcgcggttccaggagcagctcggaggggctcgggcggcagctccgcggagggggctgcgcggcccgggagcgcgaatccaccagcgcaggccccggagcacagggcgccgggacacagcccaggatccggcctcccccgggacaggcagaggccgggagggcccaggacagcaaggacgctcctgccccagctgagcacatcagcggccccgccccggagcctccaggccctgcagacggagttcctgccggagctgaatccaggtttccagagctgccccgccactggggctgttcctcctgcggcctcacggggtaaacaacccccaccgagccctgcaccaggcaggggcacagcagctcccccaactgctaacacctgaaaatcagcacaacaggcccctcccccagaacaccagctagactgacaacttccaggagaagccaagggacttaaagtacacagaatcagaagatactccccggtggttctttttttgtttgtttttgttttgttttgctttttgatttgtttccttcccccaccccctttttttctcctttctttttctttctctttttcttctttttttttttttcgtttttttttctttttcttccctttttttttctctttctcttttctttccttctttctctcctctctttttctctttttcccaatacaacttgcttttggccactctgcactgagcaaaatgactagaaggaaaacctcacctcaaaagaaagaatcagaaacagtcctctctcccacagagttacaaaatctggattacaattcaatgtcagaaagccaattcagaagcactattatacagctactggtggctctagaaaaaagtataaaggactcaagagacttcatgactgcagaatttagagctaatcaggcagaaattaaaaatcaattgaatgagatgcaatccaaactagaagtcctaacgacgagggttaacgaggtggaagaacgagtgagtgacctagaagacaagttgatagcaaagagggaaactgaggaaaaaagagacaaacaattaaaagaccatgaagatagattaagggaaataaacgacagcctgaggaagaaaaacctacgtttaattggggttcccaagggcgctgaaagggccagagggccagaatatgtatttgaacaaatcctagcagaaaactttcctaatctgggaagggaaacaggcattcagatccaggaaatcgagagatccccccctaaaatcaataaaaaccgttcaacacctcgacatttaatagtgaagcttgcaaattccaaagataaagagaagatccttaaagcagcaagagacaagaaatacctgacttttatggggaggagtattaggataacagcagacctctccacagggacctggcaggccagaaagggctggcaggatatattcagggtcctaaatgagaagaacatgcaaccaagaatactttgtccagcaaggctctcattcaaaatggaaggagagataaagagcttccaagacaggcagcaactaaaagaatatgtgacctccaaaccagctctgcaagaaattttaagggggcctcttaaaattcccctttaagaagaagttcagtggaacagtccacaaaaacaaagactgaatagatatcatgatgacactaaactcatatctctcaatagtaactctgaatgtgaacgggcttaatgaccccatcaaaaggcgcagggtttcagactggataaaaaagcaggacccatctatttgctgtctacaagagactcattttagacagaaggacacctacagcctgaaaataaaaggttggagaaccatttaccattcgaatggtcctcaaaagaaagcaggggtagccatccttatatcagataaactaaaatttaccccaaagactgtagtgagagatgaagagggacactatatcatacttaaaggatctattcaacaagaggacttaacaatcctcaatatatatgctccgaatgtgggagctgccaaatatataaatcaattattaaccaaagtgaagaaatacttagataataatacacttatacttggtgacttcaatctagctctttctatactcgataggtcttctaagcaaaacatctccaaagaaacaagagctttaaatgatacactggaccagatggatttcacagatatctacagaactttacatccaaactcaactgaatacacattcttctcaagcgcacatggaactttctccagaatagaccacatattgggtcacaaatcgggtctgaaccgataccaaaagattgggattgtcccctgcatattctcggaccataatgccttgaaattagaactaaatcacaacaagaagtttggaaggacctcaaacacatggagcttaaggaccatcctgctaaaagataaaagggtcaaccaggaaattaaggatgaattaaaaagattcatggaaactaatgagaatgaagatacaaccgttcaaaatctttgggatgcagcaaaagcagtcctaagggggaaatacatcgcaatacaagcatccattcaaaaactggaaagaactcaaatacaaaagctaaccttacacataaaggagctagagaaaaaacagcaaatagatcctacacccaagagaagaagggagttaataaagattcgagcagaactcaacgaaatcgagaccagaagaactgtggaacagatcaacagaaccaggagttggttctttgaaagaattaataagatagataaaccattagccagccttattaaaaagaagagagagaagactcaaattaataaaatcatgaatgagaaaggagagatcactaccaacaccaaggaaatacaaacgattttaaaaacatattatgaacagctatacgccaataaattaggcaatctagaagaaatggacgcattcctggaaagccacaaactaccaaaactggaacaggaagaaatagaaaacctgaacaggccaataaccagggaggaaattgaagcagtcatcaaaaacctcccaagacacaagagtccagggccagatggcttcccaggagaattttatcaaacgtttaaagaagaaatcatacctattctcctaaagctgtttggaaagatagaaagagatggagtacttccaaattcgttctatgaagccagcatcaccttaattccaaagccagacaaagaccccaccaaaaggagaattacagaccaatatccctgatgaacatggatgcaaaaattctcaacaagatactggccaataggatccaacaatacattaagaaaattattcaccatgaccaagtaggatttatccctgggacacaaggctggttcaacacccgtaaaacaatcaatgtgattcatcatatcagcaagagaaaaaccaagaaccatatgatcctctcattggatgcagagaaagcatttgacaaaatacagcatccattcctgattaaaactcttcagagtgtagggatagagggaacattcctcgacatcttaaaagccatctatgaaaagcccacagcaaatatcattctcaatggggaagcactgggagcctttcccctaagatcaggaacaagacagggatgtccactctcaccactgctattcaacatagtactggaagtcctagcctcagcaatcagacaacaaaaagacattaaaggcattcaaattggcaaagaagaagtcaaactctctctcttcgccgatgacatgatactctacatagaaaacccaaaagtctccaccccaagattgctagaactcatacagcaattcggtagcgtggcaggatacaaaatcaatgcccagaagtcagtggcatttctatacactaacaatgagactgaagaaagagaaattaaggagtcaatcccatttacaattgcacccaaaagcataagatacctaggaataaacctcaccaaagatgtaaaggatctataccctcaaaactatagaacacttctgaaagaaattgaggaagacacaaagagatggaaaaatattccatgctcatggattggcagaattaatattgtgaaaatgtcaatgttacccagggcaatatacacgtttaatgcaatccctatcaaaataccatggactttcttcagagagttagaacaaattattttaagatttgtgtggaatcagaaaagaccccgaatagccaggggaattttaaaaaagaaaaccatatctgggggcatcacaatgccagatttcaggttgtactacaaagctgtggtcatcaagacagtgtggtactggcacaaaaacagacacatagatcagtggaacagaatagagaatccagaagtggaccctgaattttatgggcaactaatattcgataaaggaggaaagactatccattggaagaaagacagtctcttcaataaatggtgctgggaaaattggacatccacatgcagaagaatgaaactagaccactctctttcaccatacacaaagataaactcaaaatggatgaaagatctaaatgtgagacaagattccatcaaaatcctagagaagaacacaggcaacaccctttttgaactcggccatagtaacttcttgcaagatacatccacaaaggcaaaagaaacaaaaggaaaaatgaactattgggacttcatcaagataagaagcttttgcacagcaaaggatacagtcaacaaaactcaaagacaacctacagaatgggagaagatatttgcaaatgacatatcagataaagggctagtttccaagatctataaagaacttattaaactcaacagcaaagaaacaaacaatccaatcatgaaatgggcaaaagacatgaagagaaatctcacagaggaagacatagacatggccaacatgcatatgagaaaatgctctgcatcacttgccatcagggaaatacaaatcaaaactacaatgagataccacctcacaccagtgagaatggggaaaattaacaaggcaggaaacaacaaatgttggagaggatgcggagaaaagggaaccctcctacactgttggtgggaatgtgaactggtgcagccactctggaaaactgggtggaggttcctcaaacagttaaaaatatacctgccctacgacccagcaattgcactgttggggatttaccccaaagatacaaatgcaatgaaacgccgggacacctgcaccccgatgtttctagcagcaatggccactatagccaaactgtggaaggagcctcggtgtccaacgaaagatgaatggataaagaagatgtggtttatgtatacaatggaatattactcagctattagaaatgacaaatacccaccatttgcttcaacgtggatggaactggagggtattatgctgagtgaagtaagtcagtcggagaaggacaaacattatatgttctcattcatttggggaatataaataatagtgaaagggaaaataagggaagggagaagaaatgtgtgggaaatatcagaaagggagacagaacgtaaagactgctaactctgggaaacgaactaggggtggtagaaggggaggagggcggggggtgggagtgaatgggtgacgggcactgggtgttattctgtatgttagtaaattgaacaccaataaaaaaataaaaataaaaaataaaaagtaatgaaaactaataacctaaaaaaaaaaaaaaaaaaaaaagaaagcagaggattacaaagtcttgctttttgtttttgtgtaaatatatcctagaatatttgttttaaaattttcttatacgcttaaggtacttttgtctaatatattgtgttcattttttgtgtttaaggaaactttggaatttcattaaagaatttataaacgtaaaggaaacaaacaatacctctcaagtgactggaaaatgacctatgaaaattcacagccaccatgtacaggatgaatatttgcagatgtataaattaatgaagatacatctcagtttttcagttttaatctctaataaagttaacatagtatgtgtaacctactcaagttattggaataaatacatgtatgcaaaaaaaaaaagagataaatagataaggaaggtgtgttgtgcacacatgtgcgtgcacacgcacacacacacacacacaaactggaatattatgtagccataaaaagggaatgagctcttgccatttacagcaacatggatggacccagaaggtattatgctaaaagcaaagtaagtcagagaaaggcaaataccatattgtttcacttacacgtagaatctaaaagataaacaaaaattagaatcagacttataaatgtagagaaccaaatgatggttgccagagaggaggggtagaaggatgggcagaataggtgaagggaagtgggagatacagacttccagttatggaatgaataagttacagactaaaaggtagagtatagggaatatagtcaatggtattataatagtgttatgtggtaacagatggtggctacacttgtggtgaagttacaatataaatcaatctgaaaaccataaagtacattagactagcaataattgtattttggacactttattgtcctttttatattctttaatacattccatgatcacactgtaattttactttgcctttttaagataagcaaatacataaatacatgaatactcttggggggggggattgtatgcatagtcttctttcctactcgtctttatattttgcatctgcctgactaggccagagttgcttagagagtttcaggggcggtctcgttgcatgatgagaatgtcctgagataagagctgcctttggagaatttccatttatactggttagctacagtacaattgacctgaacatttggtagattatgctactacatcatatgtataatgcacatgaacccacagatatctttaatgctcatattgtttattaaacaagtatttactcaaacctactacgtacagcgctctgtaggtctagtaacacctacttaaaatgacaatgaaattgacacactgcaggagtatcagtaactaaataatcaagcacaggacattgtgcatattcaactatggatgtcatctgctgccatccttaaaaggaggctgcaccattcaggattagactcaatcacaagtgacaatggctttgagatttaaaagtttatttttcattgaaaagaattcaggaattgagcaatagttctttagttccatgaagctgtcaaaaacccaagctcattctgtgttctctgccatccatgtcgtattacatagtcaaagatgttcttagagttccatccattgtgacacatccagtcatcagaaaaagtaaagaaaacaggaaaagcacacatttttttctttaaagacacatctcagaaatcatacagaataattcagtttgtaatgcactggtcatcatttaatcacattcatcaggggaggcaggaaaatctaatcttcaactaggctgttattgggtataatgataagaaaaggagtctataacaaaggaagaagggagaattgatatgaggggcaattatgaatctctgcctcggaacaccatcttgagaaagaaccagaaagaaggaagaaaaaaataaatttgtggctgctgggagtgttgtaattatcataggggctcaaggtcgtaattactcatggaaagacaggcatatgaattacattgttctccacctggacaggtggttagggagcctgagtcagggaaccaaaatctgaaaaatggttttaggtatcctaaatactaaataccactgaatttgttctgggggaaggaaaaaatgtgggatctatttgtcatattatagaaaaatacatctccagcatcataatccaggaatacccccacactaaggggtttttctcttatagtaagacaggtttctggggaggtgggggcccagtactcccccttatagaggctgatggcccagagaccattctgtggagacactgtgaccctcccctttcttattacattatccatacaaattcccaggtcctaggaaagtgtgccctcaaccttaacctccagtacgaacctcccctaactaatgtccaactgccccagcacacaggggagggagtggaatctctgggtggagctgggtagatcttgatgttcttcttgccagcttactcgtctcccgttttcagacaggaggagtgaaggatgggcagtggctgcatccagggtcacatttactgcagacaagtggactattattattctgggaaggatctcagtaggcctgagccagaggttccccactctctgagggtttctcttaccctggttagatctaactcccctctacccatcttttcctgagactggcccataaggagcaggatccctcctgcatcatcatagcctggaacttttctttcctccaatctataagcaacaaatgtacatgagaatccaccctctaaaacatagctgcctgtctcaccagaatactgtgagtataaatgccctagattaattcaggaataagagcaaccaaaggaaatactcttccataaccttaaatatctacttacctttgctaaattatgtttgacttgaagatctggcacatccctatgctctctttatataagtcttttctcttgttttcttagtctagctagatgtttgtcaagttttttgatcttttcagaaaaccagcttttggtttcattgatttttttttctcttttctttttctattcactattttatttatctacactcatctttgttatttccttcttcatgttaggtttggatttagtttgatcttcttcaagtcccttaaggtatacaattagattattgatttgagatatttattttttatttttcaatacatatatttacagctgtaatgtttaccttcatactgctttagctatattcaacaagtttcagtgtgtgtattttcactgttatttgtcataggtattttctaattttccttgtgatttcttctttaacccattgataatttaagtgtattacttaatttcaggtttttaattgccagtttttcttgttattgatttctattttagtctgttataaaaaatacactttgcattatttcaccttttgaaatgttttaatatttgtctgtaacttatgttccatcatggagagtgtttcatgtgcacgtaagaacaatgtgtattctgtttttgtggatgaaatgttctatatatgtctgttaatcagtttatagtgtagtctaagttcttttttttccttattattcatcttgctggttgctgtatctattactgaatgtggaggattgtagtatgtaactattgttgtagaactacctattcttcaattctgccagtgtttgcagcatttgttgtgaggttctggtgtttgctgcatttatatatctatttgttatatattcttggtgaattgtcacttttaaaaatatacccttttctgtatcttgtaacaattttttgacataaatgttgacttaaagtctattttgtctgataatactattatagattactatatactatacatacagtactatctatagcttttttctttgatatttgcatggaatttctatcattctactttcaatctatttgtatctttgtatctaaagtgagtctcttgtaggaaacataaattaaaatttggatgatattgtttcaaaatttggctgatattgtttctacttatatatgtcagttttgcctgtctgtgcctttttattggagggtttaatccatttacctttaccagctccccagttactgatgaggggagcctgggtggctcagctgattgagcatccaactcttgattttggctcaggtcatgatctcagggtcataatatccagcccccaataagatctgtgcttagctgggagtctgctagagatcatctccctcagtatccccacctcgtttctcaaataataaataaatcttttaaaaataattactagtgaggaaatacttacttctgttgtcttactattgattttgtgtatgtcctacagctttttttatatttcatttttctccattgctacttcttttgtgtttattttgttttatttctttttttctatatttttttatttttatttagtgaaaatttaaggtgttttgggtcaccaaatttttcttttatgtgatttttctttttctaatttttatattctttattatgtctggatcaaacatgtgtcacagtttcattgtatatgatttcagagtgatctccttgaatttttgtttttatttcttttattttaatttaaattcaattacttaacatatagtgtattattagtttcagaggtagagttcagtggttcatcagttgcaatcagtgctcattatatcacataccctccttaatatccattaccccattacccccatctcctcaccaccctctcttccagtaaatgtcagtatgttttctgtggttaagagtctcttatggtttgtttccctctgtgatataatcttattttatttttctgtcactctaggctcctctgctttgtttcttaaattccacgtatgagtgaaataatattaaaattgtttttctctgattgatttatttccttcgcataatgccctctagttccatccatccatccacactgttgtaaatggcaagatttcattttattgatggctgagtaatattcaattgtacatatacaccacatctttatccattcatttgtttatgaacattttggctgtttctacagtttggctattgtcaatattgttactgtaaacattggggtgcaggtaccctttcagatcattacatttgtatctttgggttaaatatgtagtagtacaattgctgggtcataggatagctatatttttaacttcttgaggaacctccatactgttttccagagtgggtgtaccagcttgcattcccaccagcagtgtaagacagttcccctttctccacatccttgacagtatttattgtttcctaacttgttaattttagccattctgacttgtgtaaggtggtatatatcattgtggttttgatttgtatttccatgatgccaaaaatgttgagcatttttttcatgtgtctgttggtcatttgtatgtcttctgtggagaaatatctgttcatgacttctgcccatttcatgactggagtttttggttttggagtttgatacgttctttatagatcttggatactaaccctttatctgataaaacatttgcaaatatcacctcccattctgtcagttgtcttttggttttgtcgactgttttcctttgctgtgcagaagctttatatcttgatgaagtcccaatagctcatttttccctttgtttcccttgcctttggtgacaagtctagcaagaagttgctatggctaaggccaaagagattgctgcctttgttttcttctaggactgtgatggattcctatctcacatttacgtctttcctccattttgagtttatttttgtttatggcataagataatggtcttattcttctgcatctggctgtccaaatttcccgacaccatttgttgaagagactgtcttttttccattggatattctttcctgctttgtcaaagattaactgaccatagagttgattttgataggaattgcattgaatgtatgtattgctctgggaagcatagacattttaacatttgttcttctaatccatgaacatggaacatatttccatttctttgtgtcttccttaatttctttcatgagttttttgtagttttctagtacagatcctttacctctttggttgagtttattccttggtatcttgtttttaggtgcaattgtaaatgggatcaattccttaatttctctttcttctgtttcattgttagtgtatagaaatgcaactgatttctgtgccttgattttatatcctgccacattgctgaattcctctatgagttctagaaattttggagtggagtcttttgggtgttccacatagagtatcatgttatctgtgaaaagtgagagttgacttcttctttgcctattcagatgacttttatttctttttgttgtctgattgctgaggctaggacttctagtgctatattgaacaacaatagtgagattagacatccttgtcatgtccctgaccttaggggaaaggctctcattattttccccattgaaaatattcacggtgggttttttgtacatggcttttatgatactaatgtaagttccctctattcctacactgtgaaaagttttaatcaagaaaggatgctgtactttgtcaaatgctttatctgcattactgagagattcttgtcctttcttttattaatgtagtgtatcatattaattgatttgtggatgttgaaccacccttccagcacaagtataaatcccactttgttgtagtgaataatccttttaatgtactgttggatcctattggctagtatcttggcgagaatttttgcaaccatgttcatcggggatattagtctgtaattctcccttttggtggagtctttgtctggtttatggatcaagataatgctggcctcatacaatgagtttgaaagttttcccttcatttctattctttttttttatattgtactgtcaattggctttatcgttatacaacatattagcaatctttccatgttagtactctatttttaattttatttattttattttttcttttgtatatattttttattagagtttgatttgccaacatatagtgtaacacccagtgctcatcccatcaaggacatttctattctttgaaatagcttcagaaatttggatattaattcttgtttaaatgtttggtaggattcccctgggaagccatctggttctggactcttatttgttgggagatttttgatgactgcttcaatttccttgctggttattggtctgttcaggttttctattccttcctgtttcagttttggtaatttatatgtttctaggaatttatccatttcttccagattgcctaatttgttggtgtacagttgttcatagtatgttcttataatggtttatatttcttcggtgttggttatgatctctcctctttcatgattttattaacttgggtcctttctcttttcttttgattaagtctggctcagggtttatcaatcttattaattctttcaaagaaccagcttctagttttgtttatcttttcttctgttcttttggtttctatttcattgacttctgctctcatctttatgaattctctattcctactgggtttaggctttatttgctgttttttctctagttcctttaggtggaaggttaggttgtgtatttgagacttttttgtttcttgagaaaggcttgtattcctctatatttccctcttaagaccacttatgctgcatccaaaaagttttgaacagttgtgttttcattttcattcattccatgaatttttaaaaattctttaatttgctggttgactcattcattctttaaataggtagtgtttaaccttcatgtatttgttttccttccaaatttcctcttgtgtttgagttcaagtctcaaagcattgtggtctgaaaatatgtagaaaataattccagtcttttagttctggtttagatctgatttgtgagctagtatgtgatctattctggagaatgatttatgtaactcactaagaatgaatattctgttgctttaagatggaatgttctgaatatatctgtgaagtccatctgatccagtgtgtcattcaaagccattgtttccttgttgatcttctacttaggtgatctatatccattgtgggatattaacacctactattattgtattattatcaatatgtttctttaattttgttattaattggtttatataattagccacttctttgttagtagcataaataattacaattcttaggtcttcttgttggatagacccgttaattgtgatatagtgactttcttcatctcttattacagtcttcggtttcaaatctattttgtctgatagaaggattgctacctcagctttcttttgatatccattagcatgataagttgttttccatccccccactttcaatctggaggtgcttttaggtctaaaatgagtctctctctctcttttttttaaatcgaatctgatactctttattttttaattggagcatttagctcatttacattcagagtaattattgaaagatattaatttagtgccatgtgttaccagtaaggtcattgtttctgtatattgtctctttcctttcaggtctatgttacttttgggctctttctttacttataggatagcctttaatatttcttgcagggctggtttagtgatcacaaattttcatttttgtttgtcctgatgaggcagctcttcatctctccttctattctgcatgagagtcttgctggataaagtattcttggctgcatattttttcccatttagccccttgaatgtattacgtgaggtctttcttgcaagccaggtctctatgtataggtctgctgcttgcctcatgtttctacctcaatgggttaaggatctcttgtcccaagctgctttcaggattttctttttgtgcctgaaatttgccaacttacctattatatgttaaggtattgacctatttttattgatcttgaggtgggttttctgtgcctcctggacttgaatgcctgtttccttccccagtttagggaagttctcagctataatttactcaaatataccttctgcttctctctctctctcctctctctttttcttctccctctggggccccaattattctaatattgtttcactttatggtatcactgatctgtcaaatccgcccctcatgatccagtagttatttatctctctttttctcagtatttttattttctatcattttatatttcttatcactgattctcttttctgcttcatttattatagcagttagagcctccattttttattgtaacacagtaatacctttttttatttctccagactcgattttagttctattatttctccagaaagggattctcttctatgcttttttcaagcctagctagtatctttataatcattactctgaattctagcttcaacatcttatttttatccatatttattaagtctctggcagttagtattgcctcttgttctcttttctggggtgagttttcctgtcctctcattttttccatagaagaatagatgaatcagagaataaaatacaaaaatatcaaccacgactccacaaaacatacactagacaaatcagaagagattatgaaaccaagaaagaaaaaagagggaaaaaagagaatataatcaaacaagtggctagaacagagtgatatattaggtcctggttgtatttttttctgtatgttagaagaaactagatcccaaaattgtaaagaaagaaaaacatatgtatatatatattcttcttcttttctttttcttccttctttcttcttcattcaaagagcgaatacagtcatacactgagaataaggggacagtagaattggaaatttaaagaaaatataatttttttaagttggctccatgccatgcatggagccccacacaggacttgaattcatgactctgagatcaatacctgagctgagatcaagagtcagacatttaactggctcagccacaagggtgctccaaagaaggtgggattattaattaaactgaatgcaaaagtaaggaaatgcaagagtgtaagtagccaagtaatcaagcactgaacttcacatctcctgttccacctaaatattcagttgtggatgtcatctgctgtcatatatatatatatatatatatatatatatatttttttttttttttttttttttttgctgtcatatttaaatggagagtgcatcagtcagggatagattcaatcacaaatgacaaatatccaatatataaatgtcttaaagatataaaagtttattttacacagaaaagaattctgaagttacataatggagtaggtccataaagaagcccaaaacccaagtctattctaatttctctgccattcatgtcatattacatagtcacaaatgttctttcagttccattcatcataacacattccagttagaagaaaatgtaaagaagaaaagaagaatacaattttcttttaagggtacattccaggaatcatacagaataattagtttataacacaccagccatcaattagtcacatgcagcaagtgaaggtaaaaaaatctaatgttcatatggggatgtcataggtcaaggtaattgtatgaaaacatctataactggaagaagggagaattgatatgaggggcaatcacagtctgtgtctcagacaatcataacaatggatcagtaagatgaaggaaaatatcaattagcatctccttgggtataatcatttgcaattcaaattatttctaattctttgcctttaacaaactttaatttagctgttaatcggtaggactttccaaaatagctttaaaaatctatcgtcttggattttatcatttacttcagaaggtcaaagtagtaagttatgagctttaactaaaatctttctatttccagtaatttacaattaagcatcaattagcatctccttgggagagaattataatcatcactggggccaaaaataatcgtttctcatatatttctcatataattctcataaatgaattaaacattacctccatggacagatggttagggaacctgagtcgggggaccaaagcctgaaaagtggtcttatagcacgactgaatgttatctgggtaaaggagaaaatgtgggatccatctgtcatattatagtaggatacatctccagcatcataatccaggaatatccccacactgaggggcttttctcttatagtaagacaggtttctggggaggtgagggcccagtactctcccttatagagcctgatggcccagaaaccattctgtggggacactgtgatgctccccttccttgttacattatctatacaaattcccaggtcccaggaaagtgcaccctcgaccttaacttcccagtgggctctcccagagctgatgtgcagttgacccagcacacagggataggagtggaatctctgggtggagctaggtagatcttgatgttcttcttgccaggttacttgtctcctgtcttcagacaggaggagggaaggatgggcagtggctgcatccagggtcacatttactgcagacaagtggactattattattctgggaaggatctcagtaggcctgagccagaggtttccccctctgtgagggtttcttttgcccttagtagatgtaactcccctctgcccatcttttcctgagactggcccataaggagcaggatccctcctgtatcatcatagacttaccagcctggaacaattctttcctccaatctataaggaacaaatgtatatgagatctcatcctctgaaacatagctgcttgtctcaccagaatacaatgagtataaatgccctaggattaatttaggaataagagcaaccgaaggaaaccataaccttaaatatctacttaccttttgctaaattgtgtttgacttgaagatctgatacatctctatgttctctttatataatgttccctcaggataaatagcaattaaatatttaggttgttgaaaggaaatagggaatatggcaaatctgatcaaataacttattttttgttttagttttctcagatttttagcagacaataccactctacctatgctcaacctgtgctcaaaaataacaaaactgctaaaatttaagtagataacacattgttatctactaaaacattgagtaatctactgagatcatggatgcatgctttggagttgctttgatttttagcacattgctttgtacacagtaggtattgatttaaaatatcttcgatagtaggattttctgtatcagagttcatatcacttaccagcatataattgtgccttcctccagtctggggcgggggagagaaagaaggaaactttttactttttttccttccctgttttctcttattgtcttttccatttctccctttgtcccatttcttcttctaaaatccttgggcttcctcttttaattctgtattattttcatatttcattttttttcaaatatcatagtaaaaaagatcatgtgtaggccaagtagcaatatagaagcaagacaagggagcaggagcaggaaagagagagcctaaaatcaagatgaaggatggaggaaaggaggaagaaatactgaatcaattgaagtttgcacttctgagagaatttactaaaactctttaaatttagaaagctaatgctacagatgcttctttggcaaccatagacatttttgttgtgtttctgcatactattttgctactttcaggaaggacccaagagatggaagaatagagctttccaagaaataagcattactcaccgaacttgtattgagccttcctcctagctgagagaaaagacataaacacacatgtatgttatagatgttaacatcttaaggaagacacagttaaatgtttgtgtctgcatattggccaagcaaaattcatttcaaaatcaattaaaggaatctctaaagtacattccatgtaaaaacttcactacaatttgcaaaatacaatctgtatactatacagtgtaggacatgaagatttaaataattcttcttatgtgatcagtgtaggaatatcttagaaaattgccttagactttagtgatatgtcatcaatgaattttgagtgaaaaaagtggatgaaggaagagcaatttattgaattaataattaaatgaattcaagtaaaaatgaaagaggagtaataactatgactggaaagggacagtaagcaggcaaagcatccaaaaatacttacataccttggaccacttgaaatatggtcaagagaaggagactctcatgtgtcaaggtttcacttgatgtcagtaatatgcaaagtgtgtaaaaggccaccaaaaggaggaacttctcacacttggcaactttggagtctgaacccatccattaagaactggggcaatattatatacaaaatgatgggcactttgtctcagaacacatgttgggggactcaatttaaagggcagttttctattaaatggagaaaaccacttcttcttagcctaatcacctcatctcaccaaacttataatgaaattatgacaatcatctggaagatagaagcctaagaataaatcaaaggaacgaaaggaagcaaagaaaaaaatattcttagggaagacatcagtaaaaagaatgccagaagaaagttaccaagctcctgccgaagtccttctcaaaaagaaaaaaactcatgtaaatgtcagtaaatgtcaaggaaaactaacaaagaaaatgaaaatgagttgaaaattttcagtgcacaccatattggtaacataaatgcaatcagaaacaaacaaacccaaaaccaagaaacagaacatgaaaaaaatagcaattaagtacatttttatcttagaaaagtgagaacaatttttcgacaattaactgaataagagaagaatgatgaagatgtggaaagaggaattactagaatttcatctaacatatttgtcttctagacagttttatgtatataaataattcaagtttagaccaaaatatatatttaataacataatttcctaagaaatgttaacttgttagtagcttattgaagtagattattaattttgaaaattcttttttttgtcaggctaaataagatgcctttaagtgaaaacattatttgtataattagtggtaaactatgtataaatcctaaaatgttttttttttttttagattttatttatttattcaagagacagagtaacagagagaggcaggggagagagagtaggagaagcagggtcccctcatgagcagagaccctgaagtggggctcaatctcagaactctgggatcatgatccgagctgaaggcagacgcttaaccaactgagccacccaggtgcccctgaaaaggtctttttagaaaatgtcactgactgagactgggtataatcatttgcaattcaaattatttctaattctttgactttaacaaactttaatttagctgttaattggtaggactttccaaaatagctttaaaaatctatcgtcttggattttatcatttacttcagaaggtcaaagtagtaagttatgagctttaactaaaatctttctatttccagtaatttacaattaagcagagaatttctcagcacataaatcttttaaaaacaaacagaaaatataatgtatgttgattactgactcatatatttggaagaaatgaaatttttaagatgagttatagaggaaaatgaatgctgattgtataaacaaaatgttagaagagtgtgttttaaacactcattttattttttccctaaaatgtggctttatgctttattgacatcccttaggaaacttccgtggaaatttcaaaagattagctcacttattaaattgacattttgtaaaaagcagtaattgaaaggatacaatcatatccttatacaatttatatgattccaagattttgtgtatgtaggacttttaattgtcctacattctcttttttaagagtttatttaaattcaaattagttaatatatagtgtaatattagttttaggtgtatgcttagtgattcagcacttccatacaacaccagctattcatcacaagtgcactccttaatccttgtcatctagttagcccatctccatgagttaccctctggtaaccaaaaatttgttatgtatgcttaatagtctgtttcttgatcacctctctctggcttttttatcccccatgttcatttgttctctttcttaaattccacatatgggaaatcatattcatctttctctgagtgacttactttgcttagcataatactctctagctacatcctcatcattgcaaatggcaagatttcattcctttttatagctaagtaatatttcatttgatatatatgtatatatctcacatcttctttatccattcatcagttgatggacacatggctatttccatagtttgactattgtagataatgttgtaaaaattagggtgcatgtatcccttagaattcatacttttgtattatttgggtgaatatctagtggtgtagttgctggatcataaggtagctctatttttaactttttgagggacctctatgctgttttgtagagtgcctgcatcagtttgcattcccactaacgatgcgtgtgggttcccctttctccacatccctgccagcacctgttgttacttagattttagccacttgacaggtgtgaggtgggatcccattatagttttgatttgtatttcccttatgatgagtgatgttgagcaacttttcatgtgtttgttggccatctgtttgtcttcttcatctattcatgtcttctgacaaattttttaattgagttatttatttttttggtgttgagtcatataaattctttatacatttgggacactactcctttatcagatatgtcatttgcaaatatcttcttccttttcactttttgtttgtttccttcaatgtgcagacgcctttcttttgatgaagtcccagtatttttgcttttgtttccattgcctcagatacacatttagaaagaagttttggctgatgtcaaagaggttgttgacttggttcccctcaccaattttaatggtttcctatttcatatttcggtcttttgtccattttcaatttcaattaatttttatgtatgatgtaagaaagtggtccagtttcattcttcttcatgttgccatccagtttttacaacagaatttgttgaagagactgtcttttttcttttggatattcttttttgtttgtaaaagattaattgaccatataattgtgggatcatttctgggctttctattctgttccattgatctatgtatctatttttgcaccagcatcatactgttttgttcagttttgtaatataacttgaagctcagaatcatgtttccaatttgcttttcttttttcaagtttgcttcggtatctggggtgttttgtcttatattcttttttttttaaagatttatttatttatttatttatttatttatttatttatttattcatgatagacatagagagagaggcagagacacaggcagagagagaagcaggctccattcagggagcccgatgtgggactcgatcacaccctgggtggaaggcggcggtaaaccactgggctactggggctgcccttgccttatattcttggaggaaatctctttggcatgtatatccactgtgtagtcctttttccatcttctttgtatttgatagtctaaaacatctattaatactcatctctgtctcccacattgtaacttttctaaatttagatgcctgttagtacaattttcttcacagaaaaaagaaaataatgtcatctcatacccatcttgtgagaaaaatctcatcatttctaaattacatagtaggaaaggaagaggaagcaatgaagagggttctaaatcaagtgaatccttcttggataaaactaacacattagaactttaaaaatatttcagctttacacacatcttactaatgaattcatttgtcagaaagatgatgcctccttgattgaaacaagacaaatgaaagagacaataatggaaatattgataggaagagacgatgatttggaaaggtaagatactgagacaaatcataaaatgatgtatacatttgaattgaggtagatgatcattatgacaaaggcaagggtacaaaaaatatatgagaaaatgacaaggtacacaatggaatacattactggtatttgttttattttcattctcctctaaaataaaaggaagaaaaaacagtttattccaatgaaaacacaatgtcaggaaaggaggagatcaaaaattggaacttgtttcctaatttactctgtggtccaagtggactcgtatttgttgaaattggaaccttgaggttccagacgatatttcaccaatcagtggcaatgttttacatccttctaccccttccttcaaaaggaactaaattagtaaataaactatgagagcagggaggacatgtcttcatctggaattcacaatatcaatcattcctccttcactggaatatcacctattttagataaaatgaaaatatgtatatgtatgtatatatatatgaaaggtacttaactgtgatgaaaaaaaaatacagtaaaggcacccatctgtccaaacctgtacattgtaggtagtcacatgacacctagaatgtacattaaaaagatattttcctaaatcccattcccgaaatatcaacaatataattaaaattgtcattataaagagagaatattaaaattagaatgattatattaggcttttttcagaaacctcctaggtcaattatttcttttgtccacataaaataattcataattaagatgttactttgaaatattcttaagacatttagtccttctgccaatatttatttatttatttttattatttattttaatgtttcaagtttttatttaaattccaactaattaacatatagtccaatattagtttcaggaatagaatttaatgattcgtcacttacatataacacttagtgctcatcacaacaaatacactacttaaaacccatcacccatttagcccaatgccatgtcgacctcttctcaagcaacccccatttttcccttaagagtcccttttatggtgtgcctctcttctttgttttcatttccttacattcatctgctttctttcttagattccacatatcagtgaaatcaggtacattttttatattcattcatcaattgatggatgcttgggctttttccataatttggctcttgatgataatgtgctataaaacattggggtacatgtgccccttaaaatcagtattttttttttttttagtatttttgtatcctttgggtaaataactactagtgtaattactaggttacagcatagttctatttttaactttttgaggaacacccatctatttttttaaatttttatttatttatgatagtcacacagagagagaaagagagaggcagagacacaggcagagggagaagcaggctccatgcaccgggagcccgacgtgggattccatcccaggtctccaggatcgcgccctgggccaaaggcaggcaccaaaccgctgcgccacccagggatcccaaggaacacccatctagactgtctgcaacagtttttattcccatgaacagcataagagagttctcttttccctgcattcttgtgaaatttgatatttcctgtattgttaattatagacattctgacaatgtgaggtggtatctcaccatagttttgatttgtatttctctgatgataattaatctttagcatcttttcacgtgtctttttgccatgtgtcacctgcatgttggcagaggaatagtatacatcaaggagaggggtggtaatggagggcatacagattaaaatgcaggaaatgttacagacacccaagaaacctatcattttgaaggagatcaaaagtaatggaatatcaaaaattaatatttttccctgtagtcatagtgaaaaaacaaaagtacaaatggaaagatcaatgtacaaatggtgggagataaccacaaagaaaatttgaattggctgaaaaatttattttaaattaaccctataagatttcaggtgaacactcagagaggcatacaacaggggtgcagagatcactgctttctagagatattcactggtaaataaaggataggagaatagagttaatttaatgaattgacaaaaattttaggagtttagttctggttgtttaatttataaaaatattcttcttccttttcacagtgttttggttcctatttatccagtttgttagctttagagtggccattagctgctttaaatatatttgttaaatctcagtattgcagtagctacatcatataaagttcccacaaatactgtaaaaggggatactgaaatattgttcacataaataatgtgaggtcatgttttggggtgcctctattcacatttttgtccactgattaattcacagccttattttatttgactatgttaactcatggctgaatgaagatcatcttaactaaataacatggttgcaaaatccaggaagccaaatgaacagggttctcagaaagattctgtttctcaccagagttatactatgccttcctcctatgtgagagaaaccatatagacacatatatatgagaaaggttttctaaacattagaaatgagatatgattaaagccctatatctgctaatgattgtttttgcaaaatggccaagtcatgtccattccctatttaaggaatcacatgaaatccattccattgaataaatatcattgaataccatgtgatatgtagggacatgaagatttaaataattcttgtggtgagatactgaaattggtgtagaaatatcttagaacataaccttagacttcagagatatagtatcaatgagattaattggatgaaaaatgcttgcatggggcacatgggtagctcagtcaattaagcatctagttcttgattttggaggtcatgatattagggtcctgggattgagccccacatcagaatccacgctcagtgtggggtctgtttgaggattctctctctcgctcttcctctgcccctctctcctctctctctgataaataatttttaaaaatgtatgtataaagatccccaaaaacaatttattgaattactaattgaacagataaaagtgcaagtgaaagaagagtaataagtatggttgagtgagaaaatacccagttatagtcatgtaaaaatatttatataggtctgatcacttgataatatggtcaaggggagttcaatagcaagtctcagggttatacatgaatacagtatgttcagagtgtttaaaaggccaatggaagaaaaaaaaacttaactcagaaactttggaatctgatcctttcagatttaggatattttcatattcacagtacagggcactccaattcaaataacatgtgggaaaatcaaagtgaaatggtgttttctagaatatatcctgtattcaaacaagcacattcttcttaacctagtcctttgcatctcacaaaccttaaaatgaaattataataagtatctggaagatagaagacgaagaatatatggcaaataaaggaaaggaaaggaaactggtggagagagagaatgattagggacattaatattggagaatttcaggaagcacaaataaagtggagaataattgaaaattcaagaaaatgaagagcaaagatggggtgggtaatgagttaaagaattagaaaatgccaagaaaaaaatcatttctatacaatacattaccaaaggaatgtgagtctgaaaaaatttaccaatttttccatgaagttctcctgaaagagaaatggagaaaacttttaaatgtaaaggcaaataaacatggaaaagtcagatgattggaaaactgccaatgcagtgcaacaatcattgcaataaaatggaccaccaaaggaataagaatctgaaaataattaccaatttcttccagaagtgctcctgaaaaataaaatggagaaaattttgtaaatttgaaagagaataaatatggaaaagtcagatgattggaaaacttccaatgcagtgcaacaatcattgcaataaaatggaccaccaaaggaatatgagtctgaaaataattaccaatttcttccagaagtgctcctgaaaaataaaatggagaaaattttgtaaatgtgaaagggaataaatatggaaaagtaagatgagttgaaaattgccaatgcaacataaatttttaggatgaacataatgagaaaaaagtaaacaaaaagcacacaaaaaacctgaaaaatttgcaagagagcacatgcttatcctcataaaggaggaaaatgagtgaattttctgaaataagtaagtactatacaaatgttgaagtgtcaggccacctagaatattatcccacacttatgtccttatagatggttttaggtttttagggaattcaaggtttggaccaaaatatgtatttaataaaataagataattttataaaatattttactggtagtggtcttttaaaattaattttataattttgtcaattactttgacaagtatacataagcaagttgtcattaagtgaaaacaaaacttgtataaatagtaatcaacctataaatcctggaaaagtcttttttgtggatattaaaatcatcgagaaatgaatggctgtaatgtgtggacacagatttttctgtaagtcttatggtttctaattctttgagtttaacaagtgtgctataacttaattgtcaatatatagaacttttaaaacaagctttggtaaacactgaatttttagtgttgaactcagaagaaatggaaagaattgagtgacattgctttgctctaacccattttctcccccattctaacatatattgctaagcaccaattgcttagcacctgtatctcttataaacaaaggagaaataagtggactaaaattgatgctgaaattgatttgagggaaataaaatatgtgttaatggtaatataagaattctataaatatcctgagtgctatagaaataccttcatgtatttttaagttgagcatagtgtatataaaataaaataaaacagtgagtgttgagaaaagctctctcgtgtacaaaatccttcaacctctactgtttttggtgttaattcctctgcctgactcttttcccatctttcttgcattgtttggatcctcacttcacctataaatccttatctctatctcccagttttagatattcttaaattatatacctcctggtctaattttcctcataagaaaaacagggttgttatcacctctatccattggtggaaagaaaatctaactatttctaaaccaaataacttaaaaagaaggaaaataaagcattacgtgatgagaattcagttcaaaactaatgacctaaccttacgttgggtgatatatatctgacaaacaaaagtactatcatttacacatgccttataaataaaatttacctagcagaagtgatttgcctacataaatcaaagggtaaaaacatatggaagtaataatgagggaagttgaagtataaaacaaaactgcaaactttagctggaaagataaaataatgaaggaagatcaagaaaaatatgtgtatcttggagttgatcaagatgatgatggagagttgaagacaaaggtacaagaattagataaaacaaagacatacacagaataataagttaattaaatttgctttttacctacttatctaaacacagaagatgaaccaattcatgcaaaaagaaagactaatattaggaagggaggagggaaaaacttgaaacacttctatggtttccttctggtgcaaactgactgacatttttgagaactggaaacattaagctccaaaggcattttcgccaacaataggtaattttagtttatcattctcactcctttaaaaagtacatttagcacttattttaagaaaatttgacccagggatccctgggtggttcagcagtttagcgcctgccttcagcccagggcgtgatcctggagtcctgggatccagtcccacattgggctccctgtatggagcctgcttctccatctgcttctttctctctttgatttatgtaggtaaatcacttctgtgaggtaaatttttttagtaatgcatgtgtgaatgatagtatttttgtttggcagatatatattaccccaacgtaaggttaggccattagttttgaactctcatgaataaataaataaaatcttaaaaaaaaaaaaaaaaaaaggaaagaagacccagtgaaatggtacataggactttctctgggatagccagtgccgaattattcattttgcattggccttgtaccattttgaatataaagcacaacatatatatgtgagataggttttccaaaagtgttaagtaagcatgcaataatgacacttagccaccaataattgtatctttaggattattcataacatctttgctatataaattcagatgatatcttacattctaatccttgtgaaaacataaataaaatgggaaaaatatataggtaagaagagatattaaactttatgactattttagggtcttattagagaatttggtaggaacattggatagtagattctcatgtcactcacattaaaaaaaatcagatttagaaatatcaatgaaatttccttgagaaacaaaactcctgtacaaagattcaaaaggatggcgcttgcaaaattaatccctgggtaaattaaaatgtaaagaaaaagtgtaattataatggctggaaagaaaaaaaccaggcaaaattatctaaaagtacttacacacatgagaacacttgactaatgattaatggcaataaaagagttgactaatgattaatggcaataaaagagtgagcctcagtctcacacttgacagtgaataacgtcagaatttacagaaggaaaagggatcaacgatttaactcagtaactttggagtgctcgtccatctcttaaagatggaggaagtatcatttgtatagtaatgagcacccctctctggaatacatgataaaggacttaagtaaagtattgtcaataaatgtaattgaacgaaaaccatgtggttgttggataaattcctttatttcaccaacttcataatttttacacactgacaaggcatagaatgaaagaaagagagatataggaaaagatggaaaagacaggaaaacagaagcaaaggaaacctaatatgggaaaagtgcagaaaccaaacaatggggagggaaagcagacattcaagagaaggggaagcaaagggatggcatgcaagtgaaaaggcaagaaatgccagtgatgagaggcatcatagtgcaggactaaagggttgtcagaatatttaccattacttttctcaagttctgaaaaacaaaacaaaaaattaatgttttattaacataaatatcaaagtaaacataaatgaagaaaattaaaatttgttaaaaattaagaatgtaaagtaaaaactaacaggatgctgcacacaggcacacacgcacacagacacacagtcatcaccttgctagcaggagaactcattttgacttacataatgttctccagaaactaaaaaaaggcagaggaaagagtgatgattttagtgaattatacagttaatgaggaatattatttctagtggttacattttatggattttttttataatgttattattctttcttactctaacatgttctttaactctatatatacctttctgtatttgtagataacacatgcacacacatatatataaacatatgttctttctctatatatgtgtatccatacaaatgtaatctcaccaattacatgtctattcatatgaacatatgttgtacatatatacatatatatgtacatatatatacagctacatagtaacaagtagtactcttttgtcaactcttggtatatgattttgtaattcatcgcaagaaattagaaagaagggacacctgggtgactacagttggttaagcgtctgcctcaggctcaggtcaggatcccagggttctgggatcaatccctgtgtcaggtgctctgctcaacagggaccttgtttctccttctcctccccacttgggggctttctagctatttctgactctctctcaaatcaatcaatctttaaaaaaataagttagaaagtgaataattccaatgaatacatacaaatcttttttcagctctggtcactttcacttttttacttcagaaaatattgtaagagtatccaattgaattatcagttaatcctcacaaataattatttgatacaaataatcactaaagaagtttgagtatttaaccagaaaaaatgttaaaggtaaatggtattgtcataattttattcttccttcctccctcacttcatccttctgttcttccctttctactttcttttcaattacttattctcaattatttctgtgtctccaagctttactttccccatgtcatgatggtgaccattatcatattgaagtaaactaatgaaaagagaaaataaaaataaaataaaataaaataaaaaattaaagaaaataagagagaaaattgataggaaaggaatgagagtgaagaaagaaaaagaagggagaaaattaattgaagaagcagaaatagggcagcccaggtgactcagaggtttagcacctgccttcagcccagggtgtgatcctggagacccgggagacctgggatcgagtcccatgtcaggttccctgcatggagcatgcttctccctctgcctgtgtctctgcctctctctctctctctctctctctctctgtgtgtgtgtgtgtgtgtgtgtctcatgaataaataaagtaaatctttaaaaaaaagcagaaatatttgtaaaacagctgtgttattttcactttggaagaaaccatccacattatggagatttaaaaaatctaaggagaaataaacaagaatgatgcagatgtcagtgctctctttcatcaatggatacatcatctagatgtaaaatcaacaaagaaacattgggcttgagctacactttatatcaaacagacttaagagacatatatagatcatcccattcaatagtaccaaatgcacatccttctccagtgcacaagagacattcttcaggatagatcatatgttaggttataaaacaagtcttgacaaatttatgaaaattgatagcatatcaagtatattttttatcacaatgatatgaaactacagatcaataactggaggaaagttaacaaattcacaaatacaaagagagtaggcaacgtgtcctgaaaactcaattggtcaaagaggactaaagaaaactcacagaatttcttgagatattctcaaaaatggtgagaaaagggaatcacagcatatggaaacataagggaaatagcaaaagccagtcctaagaggaaaatttagtgatcagtgcctacattaagaaagaagaaagatcttaaataaacaacttaacttgaaacttcaaggaaatgcaataataaactaaacccaaagttagtaaaggaaggaaataataaaaaatcataccagatataaatgtaataaaagcaagaaaaacaacagaaaatatcaatgaaactaagagttggttttttgggaaagataagcaaaattgacagatgttacactatcttaaaaaatgggagacttaaatgaataaaattgtaaatgaaagagaagacttcacaactgatacaacagaaatgcaaaagatcatgagatcactatgaaaaacaaattggataacttagaagaaatgaataaattcctacaaacatacatatgaagactgaaaaatgaagaaatagaaagtctgaactgaccaataatgagtaaagagattgcatcactattcaaagccctctcataaagaacagcccaagacctaataattttacagatgaactttaccaaatgttaagctaaaaattaatgtcaatccttctcaactcctctaaaaaattgaggaagtgaggacaattgcaattttatttttcaaagccagcattatcttcatataaaggcagaaaaggacactataagaaaattctaggtcgatatccctgatgaacataaatacaaaaatcctcaacaaaactagcaaactgaactcaacagcatataataaaagtcagaaaccatgatcaaatgggttttaccctgggatgaagggagatcagcatatgcaactcaataagcataatataccacgttaacaaaaataagtataaaaatcaggtaatcatctcaatagatgcaaagaaaaatacatgacaaaatccaacacctcttcatgataaaaactctcaacaagttaggtacataaaaatgtacctcggttttataagggccataaatgagaaacacacagctaaactcatactcacaggtgaaaagctaagagcttttcctatgagatcaggaacaacagaaggatgcctttagtcaccacttcttttgaatataatacgggaagtcccagctaggcaagaaaaaaaagtcatcaaaacctgaaaggaaaaaataaaacattctgtttgcagatggcttgatatgatatgtagaaaaactcaaagaccaactaaaaatgtttagaactagtaaattcaataaatttgcaggatgtaaagtaaacatataaaaatctgtcgtgtttctatacactaacagtgaactatttaaataagaaattaagaaaactaatgtctttacagtagtatcaaaaagaataaaatatctaagagtaaatttcactaaggaagttatagatgttttactgaaaaccataagaaattgttgaaaagatttaagtagacacaaatgagaaaatatcatgttcatggattggaaaatttaatattattaaaaagtacatattacttaaagcaatctatggatatgatgcaatccctatcaaaattccaatttcttttctatttctatgaaaaaaatcctaaaattcatatggaacaacaaaaaaactgaatagctaaagatatgttgagcaaaaccaaaaatgaaaacaaaacaaacagaaaacctaacaagaggcatcacacaacatgagtacaaaatatactgcaaaagtatagtaatgagcggcctgctttcccgccacggtggatgcagtggccgcagcccaggagcagctggcttcccgcgcggtggcggaggacgctggcggcgcctgggagaggagttgacgataactttcaaatcatcctgaaaacctacgaattcggcctgagatttaaagagagaccagctggaatgttacagtgagaagagttcgcgcttctatcaaggagggaagacagaaaaaaataaagaagtaaaaaagcatccaagggggaggggccctgcgaggagcagggctaaggccggcggtgagagcctccaggacaggggagccccgggagggaaagccgctggggctcccaggagggcggggatgccctcaggctcccaggggcactaacagagcacctgcgccccagggagagcgcgccacaccccacggccgagctccctaaagggctggagggcgcgcccggtggggccccgggagcagctcaggcagcggctcaggcggcggctgcgtgcggagcgggctgcgcggccccgggagcgggattccagcggcgccggcgcccgtcggggaccgcagggcaccgggggacacagcccaagatccagcgctgcccccgggacgggcggaggtcgagaggacacaaggcagcaaggacgctcctgctgcagggggccggagctgtgcagatcaccgccaccaccccaccccgcccccgccccggagcatccaagcccctgcggactgggagctggtgtaattactaagggagctgactccagagttggagagctggctgccgacactgttgttcctcctggtgtcaccttgtacctgggactgagcagaggcctcatagggataaagagctccaactgagccgtgcatctggcagggggctgggaaactcccccaggtgcacaacctgagaatctgcacagcaggcccctcccccagaagagcagctggaaggacagggaaaaagcaagttattgaccaagcagcactggaaagttccaggggaagtcgagggatttacagtatatagaatcagaggatactcccccttgttttttgctttctgttccccccctcaacccccttttattttctttctctctttttctcctttttccagtacaacttatttttggccactctgccctgagcaaaatgactagaaggaaaaactcaccacaaaagaaagaatcagaaacagtactctctcccacagagttacacagtttggattacaattcaatgtcagaaagccaattcagaagcacaattataaagctactggtggctctagaaaaaagcataaaggattcaagagacttcatgactgcagaatttagatctaataaggctgaaatcaaaaatcaattaaatgagatgaaatccaaactggaggtcctaatgaggagagttaacgaggtagaagaaccgtgagtgacagaagacaagttgatggcaaggaaggaagctgaggaaaaaagagaaaaaagatcatgaggataggttaagggaaagggacagcctcagaaggaaaaatctacatttaattggggttccagagggtgccgaaagagacagaggtccagaaactgtatttgaacaaatcatagctgagaacttccctaacttgggaagggaaacagggattcagatccaggagatagagagatcacccctaaaatcaataaaaaccgatcaacacctcgacatatatatatttttaatttttttattggagttcaatttgacaacatatagcataacactcagtgctcatcacgccaagtgccccccttagtgcccatcacccagtaacacctcgacatttaatagtgaaacttgcaaattccaaagataaagaaaagatccttaaagcgggaagagacaagagatccctaacctttatggggagaagtattagattaacagcagacctctccacagagacctggcaggccagaaagggctggcaggatatattcaggatcctaaatgagaagaacctgcagccaataatactttatccagcaaggctctcattcagaatagaaggagagataaacagcttccaagaaaggcagaaactgaaagaatatgtgaccaccaaaccagctctgcaagaaatattaagggggactctgtaaaagaggaagtccaaggaagcaatccacaaaaacagggactgaataggtatcatgatgacaataaattcatatctttcaatagttactctgaacgtgaatgggcttaatgaccccatcaaaagacgcagggtttcagactggataaaaaagcaagacccatctatttgctgtctacaagagacgcattttagatgtaaggacacctacagcctgaaaataaaaggttggagaaccatttgccattcaaatggtcctcaaaagaaagcagaggtagccatccttacttatatcagataagttaaagtttatcccaaagactgtagtaagtgatgaagagagacactatatcatacttaaaggatttatccaacaagaggacctaacaatcatgaatatttatgccccgaatatgggagctgccaagtatatcaatcaattactaaccaaagttaagacatacttagataataatacacttatagttgctgacttaaacacaatactttctacaatcaacagatattctaagcacaacatcctcaaggaaataagagctttaaatgatacgttggaccagatggatttcacagatatttacagacctttacatcgaaacacaactgaatacacattcttctcaggtgcacatggaactttctccagaatagaccacatactgggtcataaatcaggtcttaactgataccaaaatattgggatcatcccctgcatattttcagaccataatgctttgaaactagaactaaaccacaagaagaagtttggaaggatttcaaacacatggaggttaaggaccatcctgctaaaagatgaaagggtcaaccaggaaattaaggaagaattaaaaagattcatggaaactaatgagaatgaagatacaaccattcaaaattgttgggatacaacaaaagcagtcctgaggggaaaatacatcgcaatacaagcatccatccaaaaactggaaagaactcaaatacaaaagctaaccttgcacctaaaggagctagagaaaaaacagcaaatagatcctacacccagcagaagaagagagttaataaagattctagtagaactcaacgaaatcaagaccagaagaactgtggaacaaatcaacaaaaccaggagttggttctttgaaagaattaataagatagataaaccattagccagcctaaaaagaagagagagaagactcaaattaataaaatcatgaatgagaaagaagagatcaccaccaataccaaggaaatacaaacgattttaaaagcttactatgagcagctatatgccaataaattaggcaatctagaagaaatggatgcgtttctggaaaatcacaaactaccaaaactggaacaggaagaaatagaaaacctgaacaggctgataaccagggaagaaattgaagcaatcatcaataacctcccaagacaccgaagtccagggcctgatggcttcccaggggaattctatcaaacgtttaaagaagaaaccagaattattctactaaagctgtttggaaagatagaaagagatggagtacttccaaactcattttatgaggccagcatcaccttaattccaaaaccagacaaagaccccaccaaaaaggagaattatagaccaatatccctgatgaacacagatgcaaaaattctcaacaagatactagctaataaaatcctacagtacattaagaagattattcaccatgaccaagtgggatttatccccgggatacagggctggttcaacactcgtaaagccaacaatgtgtttgatcatatcaccaagagaaaaaacaagaaccataggatcctctccatagatgcaaagaaaacatttgacaaaatatagcatctgttcctgatcaaaactcttcagagtgtagggatagagggaacattcctcgacatcttaaaagccatctacgaaaagcccacagcaaatatcattctcaatggggaagcactgggagcctttcccctaagatcaggaaaaagacagggatgtccactctcaccactgctattcaacatagtactggaagtcctagcctcagcaatcagacaacaaaaagacattaaaggcattcaaatcggcaaagaagaagtcaaactctccctcttcgccaatgacatgatactctacatagaaaacccaaaagcctccatcccaagattgctagaactcatacagcaatttggtagcgtggcaggatacaaaatcaatgcccagaagtcagtggcatttctatacactaacaatgagactgaagaaagagaaattaaggagtcaatcccatttacaattgtacccaaaagataagatacctaggaataaacctaacccaagaggtgaaggatctataccctagaaactacagaacacttctgaaacaaaatgaggaagacacaaagagagaaaatattccatggtcatggattggaagaattaatattgtgaaaatatctatgccaccaattaacatagacgtgtaattaacatgttcagtgcaatccctatcaaaataccatggactttcttcacagagttggaacaaataagcttaagagttgtgtggaatcagaaaagaccccgcatagtccaacgagttaaaaatagatctgccctacgacccagcagttgcactgctggggatttaccctaaagatacagatgcggtgaaacgccgggacacctgcaccccgatgtttatagcagcaatgtccacaatagccaaactgtggaaggagcctcggtgtccatcaaaagatgaatggataaagaagatgtggtctatgtgtacaatggaatattactcagccattagaaacgacgaatgaatacccatcatttgcttcaacgtggatggaactggagggtattatgctgagtgaagtaagtcaatcggagaaggacaagcagtgtatgttctcattcatttggggaatataaataataatgaaagggaatataagggaagggagaataaatgtgtgggaaatatcagaaagggagacagaacataaagactcctaactctgggaaacgaactaggggtggtggaaggggaagagggcgggggatgggggtgaatgggtgatgggcactgagggggacacttgacgggatgagcactgggtgttattctgtatgttggtaaattgaacgccaataaaaattaatttattaaaaaaaaaaagaaacgacaaatacccaccatttgcttcgacatggattgacctggagggtattatgctgagtgaaataagtcaatcagaaaaagacaaacattatatggtctcattcatttggagaatataaaaattagtgaaaggaaataaagggaaaagagagaaaatgagtgaaaatatcagtgagggtgacaaaacatgtgagacaccaaacatgggaaatgaacaagggatagtagaagggggtgtgggcggggcgttggagtgattgggtgatgggcactgaggggggcacttagtgggatgagcactggtattatgctatatgttggcaaattgaactccaataaaaaaaaattttttttaagtatagtaatgaaaactgcatggtactaagataaaacagatatagaccaatggaacagaatggaaagccccaaaataaatccacacttttacaataaattgactttgaagaaaaatgtgtcaaaacatacaatggggaaggatagtgccttttgtgttgcaaaaactctatatcttcatgcagaaaataaacttcaaccttttcttgtaccatagaaaccaacttgaagtagaataaagacttaaacagaagacctgaaactgtaaagctaccataagaaaatgtaggggaaactcttcttggcattggtatcagcaacgaatttttggatatgacctccaaagcacagacaaagtaacaaacatagacaagtggcattgtaccaactaaaaagctttttcatagtaaagcaaacaatcaatagactaaaaattaacaatttatccacattcttaccaacagttgttaccttatgttggtgggattataagctggtacagccataaaaaaaagagtatagaagatcctcaaaaatttaaattaagagataaggaagatgacatagtaggaggaccctgaacttacctcatccgatgacatacccaggtaacatctacatgtatgcaactctgagaatgacctgggaactggctgaacagatcatggagacaaagccacatccagaaaagttaaaaaggttgaaagatctggctaggaaccaaatccccagcctgaccaaccgtaaactaaaggaacatcagaaggcacagaaaactgagattacacctcacactgggtacccatggccctggggacccatactgggaagatgagtccctataatatctgggtttgaaaaccagcaaggtttaactcttggaactttaaaaatcagcaggctgaaccttaggagagctggagtccaataggaaaccaagttcctgccatcaaagagcaagcatactaaataattaagcaagagacatagcatagatacagcagttagaaggatatctgggatatacctgaaggagatttattgactaaacttataatgtgtcctgcaggggcaggaatctacagaagatttctcagggagcaaaagaacctgtgggtattattttttctcctctttccccaacctagacagtcagatacttgtggtagctcctactaatactctctccctttttagcaccataagcctcaccctggcatgccatgcatgcctaccacatgtttttataagccatgtacctgcaagtctgaagtattttaagtccaggccatcgccaggatcattcctagtgggcttagtgatgctcctgttgggaaggagggcagaatacgagacctcttgggtcacagggcaaaaaatgattctaattattgagatgcaattattggagtggtggcatggcctctcaggggacaaatggttggcaggtgtcaagatgctgccctggtcactagtataaaaacagagatcctgtgtgggcagtaaatctaagagtcagccgtctgctattctttactatagactctgaaccactgtgtactcactggagtgcttttctggggcaaaccagcacccaccacagtgcagcaagaccctcccctgggggattagtgcaggtccatgttgcaccaggtccctaaaatttggggttttgaaacccagctgcactattgagataaagcataagagtacgctacctgctaagtaaactggacacagacagggtgaaggtggggatctgaaggaacctaatgacacaaagaggggagctgatctgccatttggtgagggatttctgaagagtggcaggtgtgaagtccctgtttggggacaggagactgtggtaatgccatttccccccagcccatcagcactatcatcagaacaacttcagtgagcaacatagcatccccagtggagtctggagctgcttacaccatgccttgccccccttgcaccctgcaggtgcatctcccctagggcaagtctgcctgagattcagcacagcaagctctcccacagaagaccggcacaaacccctcacatgcaccaagtctactgacctttggctgctgcaatcttcaggaaacagaatctagcctcttttaacaagcagaccaaaaatatccagttaaaacctgccacacagaggaaaatgtccaaacaacccccacagcaggcaagaagagactctgcagcagtctgagctgagagaaacagcagccaaaacacaatagcagagtgcacactctgaaacacctcctgaagcaccaggctcaaaacagtgtaggacctctcaatatagccattactctcaggagcaggaatataacaggcttttataaaatcacataaaaaagtgacctagacaaaatgacaagatggaggaattcatgccaaaagaaagaataggaagaaatcatagccagggatttaatcaaaattgatataagatgcctgaaccagaatttaaaacaacaatcataaggatactatgtgggtttgaaaagtatagaagacactgaagaatcccttactgcactgcagagataaaagagctaaaaactagtcaagccaaaattaaaaaaaaaaattctttacctgagatgcaaaactgactagatgcagtagatagatgcaatgacaaggatgggtgacacaagggaacaaatcagagatatagatgatcaaaatatggagaataatgaggctgtaaagaagagggaaagaaacattgaatcataaatgtatactaaggaaacttagtgacaccttaaggtataagaacagtcatatcttatgtgtcccagaagaagaagagtggaaaagggggccagtatttaatttgagaagattataactgaatacttctctaatctggagaaggaaatagacattaaatctgaaagacagagaactcccatcaaattcaacaaatactggcctataccaagtcatatagataaaattccacacatacaagaaaacaatcctgaaaaaagcaaggaggaaaaagcttttaatccacagcgggagataaatcatgtttgcagtaggtctgtccacagaaacttggcaggccagaagaaagtagcataatatattcaacgtgcagaatgggaaaaataagcaacaaagaattctttatccagcaaggctgtcattcataataaaaggagagataaagagtttcccagacaagcacaaactaaagttcttgaccatgaagcagccctgcaagagacattaaagaatgccctttgagtggggaaaaaataaagaagaccaaaagcaaaaaagactggaaaggaacagagaacatcaccaaaaacaccaactgtatagctaatacagtggcactaaattcatatctatcaataatcactctgaaggtaaatggactcaatgctccaatcaaaaggcatagagcatcttaatggataaacacacacacacacacacacacacacacacacacacacatacacacaagacttatctatatgctgtctacaagaaacttacattttagaccaaaagacacctgcagattgaaggtgagaggacagaaaaccattgatcatgctaatggatgttaaaagaaagttggagtagtcatacttatatcagacaaactagattttgaaacaaagactgtaacaagatgaagaaggggtctatcaatcaggaagatgtaacagttataaatctttatgtccccaaattggaagcacccaaatataaaaatggatcaataaacataaataaatacattgataataatacaataatagtagaggactttaacaccctacttacagcaatggacagattatctcagcagaaaatcaacaaggaaacaatggctttgagtgacacactagaccaggtggactaaagagctatattcagaacatttcatcctaaagcagcagaatacatattcttttcgagtgcacatggaaccttctccagaacagatcatatactgggtcacaaatcagatcttaactgctgcaaaaaagattgagatcattccatgtatattttcagaccacaacactataccacaaatataccacaacacagtggtatatttcagaccactgtgatgataaccacaagaaaaaatttggaataaccacaaatacatggaggttaaacaacatgtcggtaaacagtgaatgagtcaacaggagatcaaggaataaatttaaaaatatatacaaacaaaactgaaaaaatgatcatccaaaaactttgggttacaacaaaaggtgtcccaacagggaagtatgcaatgcaggcttacctcaagaagcaagaaaagtctcaaatacataacctaacttcacacctacaggagctagaaaaacaatagcaagtaaaacctaaagccaggagaagaagggaaataataatgattagagcaaaaaataaatgatatagaaacaaaaaaaatggtagaacagataaacgaaactaagagctgattttttgagagaatcataagccaatatcctgatgaacatggatgcaaaattcttgacaagatggtaggaagttgagtccaacagtacatttaaaatggttcaccacgaccaagtgaaatttatttctggcctctatgcagggttcaatatttgcaaatcaattcataacatataccacatttataaagctggtggtgtcataataccggacttcgatttatattacaaaactgtagtcatcaagacagtataatactgtcacaaaaacaggcacatagaaatggaacagagtaggaaactcaaaaatgaaaccacaactatatggtcaacttatctttgacaaaagcagaaaaaatatccaatgggaaaaaagtctctacaacaaatgatgttacacaaactccgtagcagtgtgcagaataatgaaactgagccatgttcttataccatacacaaatataaattcaaaatagatgaaagacctaagtatgagagaagaaatcatcaaaatattaaaggagaacacagacatcaaccactttgattaacatgattaaattcttacaagacacatctctggaggcaagggaaacaaaagcaaaaatgaactatgataaaatgaactcaagataaaaagcttttgtgcagtaaaggaaaatcttgttaagattacaataatacccactatattccacaaaactaaaaggcagcctatggaatgggagaagatatttgcaaatgacatatctgataaagggtttgtatgcaaaacatataaagaatttatcatactcaacaacacacacacacacacacacacacacacacacacacagactaatccagttaagaaataggcagatgacaagaatagacattttcccaaagaaggccctcaaatggctaacagacacataaaaaatgctcaacatcactcatcatcagggaaatacaaatcaaaactacgatgagataacacctcacacctctatgaatggctaaattaacaacacaagaaacaacaggcattggtgaggatgcagaaaaagggaaccctcttgcactgttggtgggaatgcaaactggtatagccactttggagaacagtatggaagtttctcaaaaagttaaatatagagctaccctatgacctgtcaattgcagtaccaagtatttatccaaaggacaaaagcagtaatttgaaggggcatatgaactccactgtttctatcagtaatgcccacaatagccaaaatatggaaagcacccagatgtccatcaatagatgatggataaagaagtggcatatatatatccaatgcaatactactcaggcatcaagaagaatgaaatcttaccctttgcaatgacatggatggaactagagggtattatgctaagggaaataagtcagagaacaattatgatatgatttcattcatatgtggaatttaagaaacaaagtagatgaacataggaaagggagggaaaaataagatgaaatcagagaggaatacaaaccataagagactctaaactataggaaagaaactgagggttgctatagggaaggagggtgggagtgtggggtaactggttgatgagcattagggagggcacgtgatgtaatgagcactgggtgttatatatgttctatgcaactgatgaatcactaaactctacctctgaaactgttagtacattatagttaataattgattttaaatataaaaataattaaaaattaaaataaaaaattttttcatcattcagtttgtaaatgttcaactaatatcccagtatttagtatggaaacaagaatcaccttatgcatcatgatctctgtgccacttctgcagagaagacacatctaatggactaaaggaggtaaactgcctgctatatgggctagaaaaagagatttagtatctaattgataattgttaaccaatcatactattataaatgcctctgctctcccaataatgatacaaaagaccgacaaggcattccaagaaaagaaaactacagaccaatatccattatgaatattggtgcaaattcctcaacaaagtactaaaacaaaccaaaatcagcaacatactaaaaggattattctggatgatacagtgggaagaactcccactggattataaggatggttcaatatacaaaagttagtgtaatacacaatattaatagaatggaagggaagaaaataaacccatgaacatctcagttgatgcagaaaaagtaattaagaaaaaaattcaaaaaaaattcaacacgttttcacgatactcaataatctaggaatgagggtgacttccttaacacaattaaagatatctgtaaaaaatctactactaacattatactcagtggtgaaagactgcaaggttttttctaaattcctgaatgagacaaggatggctggttttgccatttatattcaatatactgaaagttctagccagaacattagataagaaaagggaatataaggcatccgtattggaaagaaagaataaattatttattttcacagatgatatgttcttataataataaacacttgcagggggggaaaaacaaattcagcaaagttgcaggatataaagtcaacatgcagaattagtttcactaatatattaacaatgagaaatttaaaaggagataaagaaaacaatcccatttacaatagcatcaaaaagaataaaatattttttaaaagattgtatttatttgacagaaagagagagagaaagagaaagcacacaagcagtcggaacagcaggcagagggaaagggagaagcaagctcccgcctaacagagcccaatgtgggactcgatctcaggactctgggatcatgacctgagccaaaaacaagatgcttaacagactgagccactcgggcaccccaagaataaaataaataaaacttaacaaaagacctgtacactgaaaacttcaaaatattgttgaaaaatcaaagacataaataaatagaaagacatcccaagtttaccaactggaaggcttaatatttgttaagattacaataatacccactatattccacaaagtcaatgcaatccatacaatatttaggtgttctgttttgttttgttttgtaaagcagaaaagcatcctaaaattcatatggcatctcaaaataaccaaaacaaagaagatcaaaacagaaaaattcatacttcctgttctcaaaatttactacaaagttacagcaatcaaaacagtgtgatattgccaaaaggacagatgtatggaccaagatatacgacaaatatatgaaacaagaaaaggagttcagaaatcaatcaatctttatatatatggtcaattgattgttgacaaggtaacatggccattcacagggaaaaggacaaccttctcaagaatgatgctaagggggatccctgggtggcgcagcggtttggcgccttctttttagcgcggggcgcgatcctggagacccggaatcgaatcccacgtcaggctcccggtgaatggagcctgcttccccctctgcctgtgtctttgcctttctctctctctctctctctctgactatcataaataaataaaaattaaaaaaaatttaaaaaaagaatgatgctaagaaaactggatatttacatgcaaaagagtgaaactgaacctttgtcttctaccatacacaaaattaactcaaaatagagcaagacataataataagagctaataccatataacttttagaagaaaacatagagaaagtctttgcaacattgttttgataataaattattggacatgacaacaaaaacacaaacaacaaaatgaaaaaaatagatgaatttgactatatcaaaattaaaaacttttgtgcatttaaaggaaactatcaaaattaagtgaatgctcttttgggtaagaatgttattataggcataaaattatttttgcaagtactttttaaaaactaaaatgaccaaaaaataataatataaataaataaataaataaataaataaaatgaccagtatagtcaatgacaaccagaaacacaagaaatcaagaccacatgaaagaagtgcagtcactttggacgtttgatagcaccttaaaacagtaaacatataactaccatttgatccaggaattctgttcctagaaatatgccccaaataaatgaaaacataagtccacataaaaacttgtgtacaaatattcatactaatgttgtcagaatatccaaaaagtgaaaacaattgaaatgttcataaactgatgtcatatatccatacaaggaatattatttaccaataaaaataaatgaacatggataaaacttgaaagcgaaagaagcccatcacaaacaactgcatattatattgttccatttatatgaaatatccagagtaggcaaatccatagagacaaagagtagattaatggttgccaaaaactggaagaagaggaaagtggaaagtggctactcataattatgtttttttctttttgtaatgctaaaaatattctaaaagtaaatgtgcacccacaattaatatgtaacaactttaaatcccctatgtaaaacccctttgcatggaaatctggagtttcttttaatatttctgaaagaaaattgagatagacatttcttgtaattccaaataacataaaagagcagtgattagataaataatactatgggcccacagtttctgacccagaagaagtaattgtatttgaaggggcctcccttaataatagtgtttcttgcatgttttccttacccgttaaagtgcaggaaaactcttttgaaggcagctgcataattaaatgagccacatcattcttagggccaagaactatcagataattaaagaatcacagcaatattaaaagtcttaaagaagagtgggtaacatttatttatatccagctttgaatttgattagagaagaatgagagggtagaaatcacttgatcataatttgtttatcataaaatgtgcatttcatcctaataactctgagaagaattaataactaaaaggagaggcatcactccggtagattttaaaacagctataattacagaagcagaaaagaatgaagagtaatacttctctccatataccaaataaattataatgataagtataaaaaagtgaagccatgagaaaaaccttaaagtgaatacaggtgaatatatttctaacacttacgcttcctaaaaataatatccaataaacattatagccaaaattagccaaaattaacatacttgaccaaacaggaatattttgcaattcaaaagccatcataaagaaaatgaaaaagcaaatgacaagaatggacaaagcatatttttaaaagattttaaaaaattatttattcatgaaagacacacagagagaggcagggacagatgcagagggagaaggagggctccccatagggagcctgatgcaggactccagcccagaaccccaggatcatgacctgagccaaaggcagacactctatcactgagccacccaagtgcccctggacaaaacattttgaaatataagaaaaactaaactctaacttccttccaatgttaatatttgattatgtttaaggtatctaaaaattagtcactgaatcagatatctgagtacaaattcagcaaaaataaatctaccatttactgaatacatactatattttaaatattaggcattgtggtttttttctcataatcatccttaatcctcacagcagccctgggatataggtgttatttattcccactttataactataattcaaaggacttatgtgactttcatttaattcataaatatctggatatacttagaaataaggtttataatctatcacttaggtacactgactcagataaataatgagttaagaagtataagagggtcataatcacacacaaacatgcagacagcaactgtttatatttatgaaagtacaataaagcaggttgcactatgaaatatcatttgtatgtctacaattatattcatatctacatctatactatatatatactatatatattgtatcttcagggaagattcagggaaacattttagccaccattgatggaacttttcaagacagaaaaacagcaaactcaatataaacatgtatagactttaacctaaaaattccgtatgtatgactgtatactaaaaattatatggttttatggataagctttatgcacaaaattgttcctcagtacattactttcaaataataatttggtaacaatctaaatgtaattttacatattacatgtacatgcaaagacatgttcatttatacataatatacacataaatatgtaaataaaagtacaccagaagtatgtctgtttatatgtaaatatgtatagttatttttgtgccatattatttcctttttgtctattttgcattttttagtcattaacttttttctttttttttttaagattttatttatttattcatgagagacacacacagagagagaggcacaggcagagggagaagcaggctccatgcagggagcccttgggtctccaggatcacagcctgggccaaaagcggtgctaaaccgctgagccaccagaactgccctcatttgcttcttctttaaaacataagatagaatgaactttgtgtgagatttttaaatttctgaataataaaaagtccccagattaagatgtggtagagaggcagggccacattatcaagaatttatggaagaatattgcctattttcttagtctagctaaagatttgtcaaatttatatttacaaaaaatagcttgtagtttcattgatgttttctgttgtgtctctggtttctgtatcagcccaacatattatctatcctggagaattttccttgagacttgagcataatgtgtattctactactgctagatggactcctctttatttgtctgctaggataatttattctacagtgttgtcaaatttgctgtctccttatgatttcctatgtggatgatctatccattcaaaaaagtggggcactgatgttccatacaattattgtattgccatatatttctctctttagttaatacatgctttgtatatttaggggctttaacgttggagcatgtatttttttaaagtgctatattttattggtaaattgaccctttttatcataataaatgaccttctttgacagttttgacttaaagtctattttgacagttttgacttaaagttgattttgtatggtatttagtcaggcctgttccgttttgcttacaattcttatggaatatattctcccattccgtcacattgagcctgtgtataaagtgagtctccgctaactctgggaaacaaactaggggtggtagaaggggaggagggcggggggtgggagtgaatgggtgacgggcactgggggttattctgtatgttagtaaattgaacaccaataaaaaataaattaaaaaaaaaataaagtgagtctcctgtaaggagcagataattgagtcttactatttaaaaactccactagccaatttaatttagagccttttgatgcaaaatttaatctatttacacttaaagtaattatatataggtgagaatttatttttgccactttgttaattgttttcaatttctttttttcttctctttttgttttccttcataatactgtgatttttttttgtagtggtatgctttcattcctttctctaattttatagtttgtgtatctactacaagttttttatttgtgtttacataaatatgaggctggcataaagcatcttatggatataactgtctattttaaactgtgagcaacttttgattgctttggacagcattacacttttcctcctccccacactatgtattattgatgtcacagcttacatctttttatatcgtgtatccattaataaattattatagttattatttctaaaatacttttatcttttaaatttcatactagagttgaaattgattatgtaccacaatacagtattagaatatattgtatttaattatacttttaccagggagttttatactttcatgtgctttcatgctgctgattagtttcctttcatttcagcttgaagaattagacatataaggcatcactagtgatgaagaacccctttatatgagaatgtttgtctctcctttatttttgaagtacagattttctgggcataatattcttgtttggcactttttcagtgttttgaacatatcttactctctctagacctgtaagatttctgctgagaaatccactcacactcttaatgggggcttctttttttcatggatcatttttcctacactttaaaaattctctgtttgtctttgacttttgataatttaattataatgcatacattaaacttatttatattcttggggcttcatgaacctggatgtctatttccttgtgtttgtaaatatacctttaaatagactttctgcactctgtttctttctcttcttgtgggagtctcataatgcacatatggattcacttgattgattcccatagcccattagactctcttctctctttttctctttttgttcccatgagagcataatttcaaatgacctttgtttttattggttgtacattctgctcattcaagtctgttttcgaaaacctctagtgaatttttcaatttagttttcatactcttcagctacagtatttctatttgtttctttaaaaaaatttcttactgttgaacttccattttattcatgtattctttacctgcttttgttgagttgtccatttgtgttccactgtaactcactgagcttctttgattattattttcttttttttttaatttttatttatttatgatagtcacagagagagagagagagagagagagagagaggcagagacacaggcagagggagaagcaggctccatgcaccgggagcccgatgtgggattcgatcccgggtctccaggatcgcgccctgggccaaaggcaggcgccaaaccgctgcgccacccagggatcccaagattattattttcgattctttgtcagacaatttacagatctccattctttagggttagttaccggagatttgccttcttcctttgattgtgccatgttttcttgattcttcgtgttcctcgaatgtttgctttgttgtctgcatgtttgaaaatgaagctacctctcccagtctttatggactggttttgactgagagataatttcactggtctgcagtgtttgaggctgaccttttggggagtgcactctacaactatggccaatgacaccctcccttccttccttttttgaaaacaaaaatcaaaaaaaaaaaaaaaacaaaaaaaacaaaaccctcagtcttcctcatctcaatcaaaccaaacagtgccagctgtggaagaaaactttactttgttgctgctgtcaggcactcaaaatgaggccagatggaaaccaagtccatgtaaagtggtctgtgttactgggggtaagtcctctttcacttctctccttgatggaggaaaaacccaagttctgccttttttcccaatcctacaaagcagttcttgctgtaggagcatagcctcccttttcctttgttagtagttgtgtgaagtcaccagacactgcaggtaatttggtgctccatgaggcaagatagaaataaactccatagggggcacatctaaatgcttactttcctatgctcatattttgttgaggattcttgctgatatcaatattcaaacgtctttgttttgctttggtatcagaataatggtgttctcatagaatgagttaggaaacatttgatcttcagcgttgaagattttgtgaactattggttttagttctttgttaaatgttggattgagcttgccattgaaactatctggtcccgggaagattcgtggagagatgtttaatggttttatttgtggggagatttttaattaccaatgcaatctcctcagtagttatgggtctgtttagattttctgtatctccatcattcagtcttagtatgttgtgtgtttctaggaattttgcatttcatataggttatccaatttgtgtacaattgcttatagtactttctcatgatactttaaacctctataaaataattataagatcacacttcctttctgattttagttatttgtgtcttcccccctttttaaagtcaattaagtgagagactcatcaattttattaattattttagagaatcagtatttgggttgattgattttccttattctgtattttttttaaatcactcttgtctttattatttcctttgttctgctagctttgggtttagtttgttactttacctagttcctaaggcataaaatgaggttgttaattggaattctttcttattttttaggttaggcatttaaggctataaatattcctattagcactgcctttgcagcctctgatacatcttgcatgccatattttccttctcatttgtccataggtatattctaatttatcttgtgatttattctttgacagattggttgtttaagagcatgttgtttaattcccacatatttggggataatctaatttttccttctactcttgatttccagattcagtccattgtgataaaaaaaaactttgtataatttcagtccgttaaaacttattaagaattggagttttttgtctaacatataatctatcctgaagcatgtttgatacacaataaaaatgtgtattctccttttgttgagtgcaatgttgtgtatatgtttgttagattcaattgtatttcagtgctgttcaagacttctatttcttagcgataatctatctagttctatccattgttggtagttgggtactgagatctccaactattattgaagagctatttaattcctctttaaatgctgccaatatttgcttcatgtattttgaagtactggtgttgggtgtatatgtttatgattgttatatgttcttggcgaattgactcttttgtcatttcacaacatcattctttatctcttgtaatagttttttatttaaattctactttgatattagtataggcaccccagttctcttttggttgttatttacatgaaatacattttttattctttcactttcaatctatttgtggcagatgagctagtgagtcctttctggacaatgtaaaattggattatttttctcttattaatctctcaatctatgatttaattggggattttaacctacttacacttaacgtaattactgataagcaatggatacattaatcacttggtaatttgttctctgtatgtctgaaagcatttttgtcccttttttcctcactaatgcctgcttttgtgttttgtagatttttttgtgatgtaatttaattttcttctcatttctttttgtgctttgcatattgtgtgtgtatatatgcattataaagtatatattttattataaataaatattataaatatattttattataagtaaagcatatgtatttattaatcatattatagatatatattttgggagggattacatctttcaaaaagattacatataacattctgaagttataataatataattttgaattgataccaacttaacttcaactgaatccaaaaattcttggtgttcaatttactaacatacagaataacccccagtgcccgtcacccattcactcccaccccccgcccttctccccttccaccacccctagttcgtttctcagagttagcagtctttacgttctgtctccctttctgatatttcccacacatttcttctcccttcccttattttccctttcactattatttatattccccaaatgaatgagaacatataatgtttgtccttcaccgactgacttatttcactcagcataataccctccagttccatccacgttgaagcaaatggtgggtatttgtcatttctaatagctgagtaatattccattgtatacataaaccacatcttctttatccattcatctttcattggacaccaggctccttccacagtttggctatcgtggccattgctgctataaacatcggggtgcaggtgtcccggcgtttcattgcatctgtatctttggggtaaatccccagcagtgcaattgctgggtcgtagggcaggtatatttttaactgtctgaggaacctccacacagttttccagagtggctgcaccagttcacattcccaccaacagtgtaagagggttcccttttctccgcatcctctccaacatttgttgtttcctgccttgttaattttccccattctcactggtgtgaggtggtatctcattgtggttttgatttgtatttccctgatggcaagtgatgcagagcattttctcatgtgcatgttggccatgtctatgtcttcctctgtgagatttctcttcatgtcttttgcccatttcatgattggattgtttgtttctttgctgttgagtttaataagttctttatagatcttggaaactagccctttatctgatatgtcatttgcaaatatcttctcccattctgtaggttgtctttgagttttgttgactgtatcctttgctgtgcaaaagcttcttatcttgatgaagtcccaatagttcatttttgcttttgtttcttttgccttcgtggatgtatcttgcaagaagttactatggccgagttaaaaaagggtgttgcctgtgttcttgtctaggattttgatggaatcttgtctcacatttagatctttcatccattttgagtttatctttgtgtatggtgaaagagagtgctctagtttcattcttctgcatgtggatgtccaattttcccagcaccatttattgaagagcctgtctttcttccaatggatagcctttcctcctttatcgaatattagttgccaataaagttcagggtccacttctggattctctattctgttccactgatctatgtgtctgtttttgtgccagtaccacactgtcttgatgaccacagctttgtagtacaacctgaaatctggcattgtgatgcccccagatatggttttcttttttaaaattcccctggctattcggggtcttttctgattccacacaaatcttaaaataatttgttctaactctctgaagaaagtccatggtattttgatagggattgcattaaacgtgtatattgccctgggtaacattgacattttcacaatattaattctgccaatccatgagcatggaatatttttccatctctttgtgtcttcctcaatttctttcagaagtgttctatagttttgagggtatagatcctttacatctttggtgaggtttattcctaggtatcttatgcttttgggtgcaattgtaaatgggattgactccttaatttctctttcttcagtctcattgttagtgtatagaaatgccactgacttctgggcattgattttgtatcctgccacgctaccgaattgctgtatgagttctagcaatcttggggtggagacttttgggttttctatgtagagtatcatgtcatcggcgaagagggagagtttgacttcttctttgccaatttgaatgcctttaatgtctttttgttgtctgattgctgaggctaggacttccagtactatgttgaacagcagtggtgagagtggacatccctgtcttgttcctgatcttaggggaaaggctcccagtgcttccccattgagaatgatatttgctgtgggcttttcatagatggcttttaagatgtcgaggaatgttccctctatccctacactctgaagagttttgatcaggaatggatgctgtattttgtcaaatgctttctctgcatctaatgagaggaccatatggttcttggtttttctcttgctgatatgatgaatcacattgattgttttacgggtgttgaaccagccttgtgtcccagggataaatcctacttggtcatggtgaataattttcttaatgtattgttggatcctattggccagtatcttgttgagaatttttgcatccatgttcatcagggatattggtctgtaattctcctttttggtggggtctttgtctggttttggaattaaggtgatgctggcctcatagaatgaatttggaagtactccatctctttctatctttccaaacagctttaggagaataggtatggtttcttctttaaacgtttgataaaattcccctgggaagccatctggccctggactcttgtgtcttgggaggtttttgatgactgcttcaatttcctccctggttattggcctgttcaggttttctatttcttcctgttccagttttggtagtttgtggctttccaggaatgcatccattactcctagattgcctaatttattggcgtatagctgttcataatatgtttttaaaatcgtttgtatttccttggtgttggtagtgatctcacctttctcattcatgattttattaatttgagtcttctctctcttctttttaataaggctggctaatggtttatctatcttattaattctttcaaagaaccaactcctggttctgttgatctgttccaccaaaaattcttttatacacctccattgttctgtccccagtttatgttattaaaattgtcacaaattacctctttatgtattttggactcatatagatttataataactctttatgcatttgtttttttaaatgctagagaaaataacaagtggtatcacaaatcaaaatcacaataatattgtttttttatatttgcccatttatttccctttcttggtgatctttatagcattatatggctttcagttcccatctaacattcttttatttcaacctgaaggaataccttcagcatttcttgtaggacaggcctatttttaaggtatgcttcagcttattttcacctgagaatgttaatttctcctttattttgaagctcagtttttctaggtatagtatttttggctgacaagtttttctccccattatagctgccttccctttctgtcctccaaggtctttggagagaaataggctaatgattttattgagcatcccttatatttgaggagtcacttctcacttgctgttttcaagactctgtctttacgtttcaaaagtttgattataccatttgctgtgaatcacttttcatatatttttcttggagggttcattgagcttcttggatttgtagatccacatattttatcaaatttcagaaattttcagccattatttatataacctctctttctttctctctcctactgcttgggcctccatcacacatatatttgctctctcttgataatatcccacaaacctcttagactagactcactttactccgttctatattcttccaactcctcagactcaaccttttcaactatcctatcttcaattcactgattctttcctctgcctactcacatgtgttattgaacatctctaatagttattatattttttagttccagaatttctattttgttcttttctataatttctatttctgtagtgatattttcattttgttactatattgtctttctgatttcttctagttatttgtctgtgtttttattcagttctctgtatatatttaagacagttttgaataactttgtaaacctgatgtctgtgtttcctctggtatgatctgcaaatttattttcttcatctgatggtaatgttttcttgttatttgtatgcctttattttgttgttattgttgttattgttgaaatttatacatttgaaaaagtagccctcccccagtctttcctgaatctttctgtaccaaggaatttcttcactgattagctgggcatgatctgagcgtagggataataccaagatgaaagcttaaggttttctcgggtctcttttgagcagtgtcttatgttggccttcatgtgtttttctcaattctctcatgtacctgggtacttttaaattccttaactttccagagtttcctcccatgtctctcagagtctgagattgtctattgtatgtctccacctctaatgacttgccaaaagggtttctgggtctaggctccttactactttctttaacaaatgcattgcacttttcatgtctaagatccaaattagataagacagatatcagccctgaaggtagtccccaggcatattagactgctgtaaataaggaacagaagtgggaggtgtgctgatatttcccctaacccttgtggtagaggagggcaaaaggcaagtaaatatgctacaaactttcttatcatttgaacatgtttcagtcttaattggacattcatttggttactgtagatgtttgactattttccagaacacttaaaaatttattcagcaaaaaaaataaaaataaaaattaaaaaaaaatttattcagccaatttctctgtttgggttttcttgaggatcaagagagcttcatacttgcattttgctggcatcattctttcactgttatttgttaaagtttctcagtcatcttttggttggttaaagcttatcctttactagaatccttaggactaatatcctcctttcttaagtttcctgaaaaatatgcttcaattttgtattgtttttgaaaaatatactactgataaaagttttttttttttttttttttttttttggtggtagtctttcttttcttctggggatcctaaagattttttaaatttatctttaacctttgatattaatactagaatttgtttcagaattaatttttctgggtcaatttttcttttacttgaaaatttttcatgcgtttttattttatttaaaaagattttatttattttttcatgaaaaacacagagaaagaagcagagacataggcagagggagaagcaggctctccacagggaacccaatgtgggacttgatgccaggactcaggattatgccctgagccaaaggcagatagatgctcaaccactgaacccacccagacatcccatgaattttgcttttaaatatgattactggttcactattttgattttcttctttttcaattttcttcattcttcttgattttcaagattttgaatcactaatatggaatgttcaatctttttttctggcatttctactacttgtttctgatcctttatactcaaaagagaaacctttaaaaattctatttttttgttttcttcaatattctttacaaaatttattatctttattctattatctttattctttattcttttaaaatttcctttctgatttcggtgaacctttgtgcaatttctttattatttttgcatttctgcctttgtatttgcatttttgattcaaggtgttctttttttcccccatgtcttgaaatgcttgcttatacatatttaatacagtttacaatatgatataactgacttcttcagttttatacttaatttaggggatatttttgtttgcacaaaggacttcgtttgcattttctgacttttacttaaagtcatgtatggaaattgcttgggtatttctcttcatttatttaatggacagagtatttaaagatgtttttatttatttatttatttattttaagatttatttattcattcattcagagagagcgaagagagaggcagagacacaggcggagggagaagcaggctccatgcagggagcccgatgtgggactcgattctgggtctccaggatcacaccccaggctgcaggcggcgctaaaccgctgcaccaccggggctgcccaaagatgtttttatttattacttatgttctcatctttacagttactttattaatggttttggcaacaggggagaccaattatctatctttttttcctcttccattctaaatgagccttcattcatctcccttagttgattctttcctcctttcttttctctatcaataagacattttccccagagggaatagttctcctgggtagccactttacttcccacatagtttcaagtcccttttccacgtttagattttgatctaccaggtcccaatctttgtttagtcattttttttgctttttgatttaatttatttttacgggactaattttctgttactaaacttacttattctttctagaatccgatttcttgtatccccttatgtagacaatcatatcacccagaaatagagaatgtcttatttattcttttccaatatgcatagtttaatttctgtttcttgccttattgatctggctagaatctctaccaactatgatgtttaatgagagtgatgagagcagacatccatgtctcatccagttttgcaggaaaagcattcagtcttcattcattgtgatgttaactgtagtttttttgtttgtagatgccctttatcaggttaaagactttcacttatatttctagtttgttgatagttttcaacaagaatagaagtatggatatttaatttttattgaatatgttttatgtctttattgtagtgatcacattatttttcttttttagatcatgctatggtaatttatattcgtcacttttttttttttttatcttggaccagttttgcattcctggaataaacttgatttaatcacactatattatcttttgcatatattgctgtatttacttgctaatatattttgagaatttttttctatgttcttggaaatattgacctgtatttttcttttagaatttttatctgattttttgtatcatgataatgttgattttataaagcgagataaaatatttttctatctcttttatattctggaagtggtttgtaaactgatgttactgcttcagatgttcagtagaattcccattgaaaccagctgggcttggatttttctctgttgaaaaattttaaattacaaattcgatttattcagtagacataggacaatttagattatctatttattctgtaataatttttgccattggcatttctcaaggaaattgcctatttcttataatttgttgaatgtataggcttgaactttgatcacaatattgtctattttttaatgtctctaagtctttagtcattgccttctttcatcttaatcttggtaatttttgccttctcatacatacatgtatatattttacttgccagtctggctaggggttgatcaatttcattattttatcaaagtacaaacttagctattaattttttctatttttcagctttcaatagaattcatttctgatattatctttattgtttatttccttttaattgctttgagtttattttgttcatttaaagaattttaatgtggagttttagataactaatttgagacttaaataaataaataaataaataaactaatttgagactttttgaatataagaatataataaattcttctctaagtactgttttaacgacactcataaataatgatatgatgcattttcattttcatccaaaatattttttatttcttgattatttcctccttgattcatattctgtttagcagtgtgttgtttaatatccaaatcctggggggtagtgtataatttgtttatatttctgttactgatatataattaatttatgatcatagaacacaatttgtatgatttctattacttcaaacatgttaaaatatgtctgtcacctggattttgtttttagtttatgttctatgtgcaattgaaaacagttctacaatcatttgtagagtgttttatcaatgtcaaattgattgagattgttatttagttattctaaatcctattgtttcctgtctactgaaagaggaatgttgatatcttcaaatattattattattttaaagattttatttattttttcatgagagacacagagagaggcagagacgtaggcagagagagaagaaggctccctgtagggagcccaatttgggactcaatctcaggacctgagatcatgacctgagtcaaaggccaatgcccaactatccaggtgcctttctatcagttttcacttcatgtatttgacgttttgctacaaagttaatattttctgttaatttaggagtattaatgatctcaaagaatttactgaggttttttgtttgttcttgtttttaaagattttatttatttatttgagagacacagagagagaagagagagagagaatgagagagtgagtgagccggggaaggggcagagggaagagagagaagcagactcctcgctgagcaggaaacctgacatgaggcttgattccaagaccttagcatcataatctgagctaggcccccattatgattatttaatgtctaattgtatcccttatattttgtgttctatttttcttaagaatatgtcttctccagcatatgttagtattgtacatatttttctatcctatttatttattatttatattttttattttaaccaatatttgttttcaatgtgggtttctaatagtgtgtaattgggcctttcaaaaagtccaatatgatgatctctggcattttgattgacatatttagttcatttagaattaagatatctatcttaaccgctgttaagatagatttgaaccgctgtattacatctggttaatgtttgtccctgtacttttttctctgttccctcattcttgccttcttgtgagttattctagcactttttagtattctattttaacttaattattgtatttgtattttggcaataaatctttacattctatttgtttacatttgctctaggaatttaaaaagttcatacctaaactttcttattccacttagaatgaatattccaccacttcaagtaaaatgtagacatcttaaattcatacgtgcattattactttccttttcttatgtcatagttttcaggtgtattatttcacatatctgagaaacacacactgttaaaattattatattcaatagtcattcatatttttaagtttaaatattaaacttagaaaatattatttcacatttacctacacatttattatttttgttgcttctattaatttctgatgttcctagttttccctatgctattgttttcctttatctattgtttcctattgtgttcctttcagaacagctttttttgtcatatttttagaatagatttcttagtgatgaagtctcctagttttcctttattttatctgtattcttaaaagatttttttcatggagtataaaattatgaattgatgtttttcatttcagtgatttattgtttatattctacatgaatttatttttatttatttaattttaattatttattatcttattctacatgaatttattgtttttattctacatgaagagaacatggtgttggcatgaagacagacaaatagatcagtggaataaaattttgaaaccagaaataaactcatgatcatttgattttttcaaaagatgccaaggcaattcaatgggggaaaggtatagtcttttcaagagtcagtgctggcacatcagatatccacatgcaaaaagatgtcttgggatctttccctcaccctacacaaaatttgaactcaaaatgtgtcatagacctaaaggcaagagctaaaactataaaaccttcagtaagtaaaaattggagaaaaatatttgaaactttgaattatgcaaggacttctgagataggaagccaaaagcttatgataaaataaactgctatattggacttcatcaaaattaaaaccgctatgttttaaaatacactgataagaaagtgaaagaacaatacacagactagaagaaaatttgttcaaatgatttatctgataaaagatttgtatccaaatatgtaagatttcttaaaagtaaaaaataggatgacaaacattccaattgaaaaatgacaaaatagagatggcttagttgtttaagcatctgccttcagcttaggtcatgttcccagcatcctgggatagagccccatggggaaatccttgctcagtggggagtctgattctccttctccctctgaccctacccccacatgtgcactctctctctagcttgctgtttttctcaaataaaatctttttttaaataaaaaaattttaaaggcaaaataatagatatttcatcaaggaaggaatacaaaatggttataaaccacatgataaaatattcaacataataaggattacaaataataacaaatggtgtcatgcattgctgcccaaatgtaaaatggtattttggtaaacagtttgatgattttattaaatgttaaacataaatttatcttatgatttagaattcccattcctaagtgtataaccaagagaaataaaatacattttcactcaaagatgtgtatgtgaatattcctagtagaattgctcataaggcttcaaaagtggaaactggtgcagtcactctggaaaacagtatggaatttcttcaaaaagttaaaaatagaactaccctatgatccagcaattgcctgccgggtatttacccaaagtatagaaaaatattggttcagaggggcacatgcatcctgatgtttatagcagcattaaataaataaaaaattaaaaaaataaaataaacagaacaaacatgtcaaatagtaaagcagtaaaatagttttaaatttaattaaatttcttgtgactgaacccttcaaaataatttcctaaagtcttctttaggcatgatatcattgtcataatcatcaccattgccattaccatcattatcataatcattatcattgtcattgtcactaccatccccagcattcccactgacattcattaagcgctttctctgcactaagcactgtgatacatgcttcataagcagcatcacatttggttaccagaagtacttcggaagttatgatgcttaggcagaagaataaactgagattagagcaaggctacattacttgctgagtttcccacagtccttatttcagagtggaattttattcaaagtgagtattctattactagaaaaatatattttcagtaaaagagaaaaaaaaagcattagggtaaagcaacagtctccatgtaactatgtagtgctatgcaatactatgaaatacacagcaatattatgtgaagagtttggaagaccttcaaaaaattaaagaatagtataagacataccttttttttttcttatttcagccactttatttaacaatctaattagcaatttaacattatgcttcatttttcctattaggataggacatttagagtgctttgaaaatggtcagccaaaaaaaaaaataaataaaaaataaaaagaaaaaaaaaaaagaaaagaaaatggtcaaccaaaacctccaactattaaattatatacacaggcctgtcttattcattattttatgttcttctgtatatatagtatttacttaaaatggatcaaagaccaaaattcgagagcataaaacaataaaaatctttttaaaaaaatagaggtacagtggagaacctgggtggctcagtcagttaagcatctgactcttgatttcggctcaggtcatgacctcaagactgtgggaactagcccctaatcaggctccccacgcagtggagaatctgcatgaggaacctctatttctgctcctcccccactcatgtgcacacatgcacgtgtgcacgcacacacacaaattctctctctcaaacaaaataaatcttaaaaaaataataaataaacctgaattcataaaagtcaaaattatggatcaaaacagaagcagtgaagagataatgtgcataatgagagaaaatatttgcaaattatgttttgagggcctaatatcaagaatatataaagaagctttacaacttcatgacaaaaagaaaaacaatccttttagaaaatggataaagaagaggtggtatacgtatacaatggaatattattcagccattagaaacgacaaatacccaccatttgcttcgacgtggatggaactggagggtattatgctgagtgaaataagtcagttggagaaggacaaacattatatggtctcattcatttggggaatgtaaaaattcgtgaaagggaataaagggaaaggagagaaaatgagtgaaaatatcagtgagggtaacaaaacatgagagacacctaacttgggaaatgaacaaggggtagtggaaggggaggtggtcgggtggttggggtgactgggtgatgggcactgagggggcactaggtgggatgagcactgggtgttatgctatatgttggcaaattgaactccaaataaaaaaataaaaataaaataaaataaaaagaaaatgagcagaagaccggaatagacatttattcatggatatacaaatggtcaagaaagacatgaaaatatgctcaacttcttttgtcattagggaggtgcacatcaagattacaatgagataccactttataggtaccagaaagaccataatttaaaaattggaaaataacaagtattggtgagtagaggagaaattggaactctaatacattgctgtttgtaatgtaaaatagtactaccagagtggaaaataatttggcatactgtgtaaaagttaaacatagtatattgtatgatccagtaattccattcatgggtctatagcccccagattgaaacaggtatttgaacaaatacctgtgcaaagatattcatagcagcactactcacaaaagtcaaaagctagataaatcccaaaggtcaatggataaacaaaatgtgttacacccatacaatgaagtctttcttattcaatcgtaaaaaggaataaagtactgatatgtactacaatatgaatacaagcctcaaaaattttatgtaagtgaaagaaggcagacacaaaatgtcacatatttgttaatcccatggatatgagatcctaccagaaaagggaaattcacagaaatagaaagcagatagtgattgccagagactaggagtggtaggagaatgagaagtgacttaaagagtatggagtttacctggggtgatgaaattctttttggaactagatggaagtaataattataaaatattttaaatgtactaaatgccactgaactgtcaaaatggttaatttaatttaatgttatttaatgtttgaattttatctcaataaaagtaagaaatcaaatcaatagaagtgacctgcaaatgaaataacagaaggtcaccaattcatttactaatagacaaagtccttggttcaacacaacgccaagatgcccagtgctactctcatcagtcaagagctgacattgcttaaactgcatgatttgtacttatgtgaagatgaaatgcctacctgtcttttgcttagtttcttccctccttgctcctgaaaaagaaaatagacaaaaatttggagagtttagaaaaaacaaaacaggaaaaatctgttacatattaaattgaaacaaattgcaagtgtagcaatagagttggtaatagattggtatactgggaggaaaattttatttgctataatgtgaagctactgaaccccgtttctttttattgtcttattctttttattttctttttactgagtttgctgcaatgatacactttctaagtgatttaagatttgaaactcaccattttttattttctctgtaaatcatatgaaaaatattgataaaataagtgaagtgattcataaataaagatatatagatgatcaaatattagttcttttaggagcaaattctgcttttacaaaattctaaagtaccaagagcaatgcttttatccaagacaggttttccttcaataatatattttctattttggtggagataaatttccctttgacttcctcccttttctctaaataaatgcattaaataattaattttttaaaataactgatacaacataaaaataaattaaaagagggtaagacttatcaggtcattaattaattaaatcttctgtttatggatgaagagaaaactccttatttcacattttcaaaacaaaatagaagaaatttttaattttcaggattcacaatctctttatcttatttctattcatatgtttttcccttctcatttgttccttctgttatttcctgtatgcttgtagaagtttctttagcatttcttatgggacaaatgtggtaactagtttcttcttttcttgacttttcttttttccatgcattaaagtttttattttgtcttttttgctgaagtctattttcactgaatatatagactactaggttgacagtcttttctttcagtattttaatgatttcactttattgtattcttgttcctatgatttctggtgtgaaataacctggttttgaaaatttctcctttgttgttttacgttagatacctccaagagttatttatcttcagttttcaaaaattatgattgtaatatttcttttttttttttttgattgtaatatttctaggcttgttgctggtgttgttaattttagttacttgatgggtgtgaggtgatatctcattgtaattttgacttgcatttccctgataatgagtgatattgagcatcttttcatgcatcttctggccatctgtatatcttctttggggaaatgtccatttatgtcttctcatcttttaatcaggttgtttattgggtgtttctcttacactatctagctccatccatgttgttgcaaatggcaagatttcattcttttttatggctgaataatattctattttgtatatattctatttcttctttatccattaatctatcgatagagacttgggatgcttccataatttggctattgtagataaggctggaagagatgtggggatggcttatatcctttgtatagagaactttatatattttggacactaaccctttatcagatatgtcatttgcaaatatcatctcctatctgccacatctcttaggttgtcttttagttttgttgactgtttcctgtgctagaacttttcatattatctcacatctccaaggcttttgttcattatgtctatgttttcctatctgttcttcagctaggaaaattctgtggatttatgttccatcttctggtctttttgcttatcatctgcattttcctattgtgctaatgcagtaatatttaaatttcagatgttatatttttcaattctaaaattttgatttaactattttttctagtttctttttttttaagattttatttatttattcatgagaaagagagagaggcacagacacaggcagagggagaagcaggcttcatgcagggagcctgtgtgggacttgatcccgggtctccaggatcacgccctggactgaaggcggcgctaaaccgctgagccactgggctgcccttattttttccagtttctatttatctgctgtgaattttcattcttttcatttctaatctcttttattttacttgatgtagcccagcaaccatagtctccctcccttctttaaacatttttatataaagctctgtatattctttactcagatccccctaatgatagaaaatatcttgtataactgtagtaagatatcaaagccaagaaattgacatgggtataatactgttaactatgcaacatacctcatttgagtttcatcatttttgcatgtgtgtgatatgcatgtgtgtgtttatgcaatttctcccatctgtgtatatccaggtttccctggaggaacagccttagagttctggtattttatggggccaactgagtatacttctcagatattaaatgcttagcatttagaagtcaagctacagggatgcctgggtggctcagtggttgagcatctgcctttcgctcaggtcctgatcctggggtcctgggattgagttccgcatcatgttctccacagggagcctgcttctccctctgcctatgtctctctttctttgtgtctctcatgaataaataaataaaatcttttaaaaaaattctttaattcaaataattgatttccttgcatgctttaatatatttataataatttaattaaaaaatctttgcctaataagtccaacatttaacaccccaagttcctcaggcacagtgtctgcctttttttcatgtatgggccatactttcctgtgtatttgtgtgtctccaaatttttggataaaaactagtactgtgtcaactctagaaatccaattcctctccttcctccaaggcatgttattgttgttgctgctctttatgtggttagtgatttgcctgactcttgacttccctgtagtgtgtagccactgtagtctctgattacttagcttattggtcagctaatgattaatcagagattttgttattgccttgaggtaaaacatttccaacttttgctaaggggttctctgtatgggttgggatatgcctgtctgcttagaaagtttacaactttgctttagtctccattttctgcttccagcttcaatcagctagaggtgagagattggaatgctcttaggctcccctgggcattcaacatagccctgcacgtgcgagcagttttctagatttccaagtcaggatttctcaaagtcccctttgtacatctcattgcccagatcttcctttaaaagttttgttccgattcttatttgcctgactgatatcatatttctaggtagatgtaaaaatgtgcagttgattatttttgacaaattccctgaggatagagtttttcccattaaggaagttctaagcctgatcaaataatggcaacatcttgtgaatggtgcttttccagggagctgtgagacaggtcaatatggcaatactttgcttgtttcacagctaccattgttgccaggctgctgttttattttttatttttttttatttttttttttttaacagagtccagaaggaaatgtgctctgataaactgattttttttatttatttatgatagtcacagagagagagagagagaggcagagacacaggcagagggagaagcaggctccatgcactgggagcctgatgtgggattcgatcccgggtctccaggatcgcgccctgggccaaaggtaggcgccaaaccactgcgccacccagggatccccgccaggctgctgttttaaaggctatcacagggcagtcccggtgacctagtggcttagcgccaccttccgccaggggtgtgatcctggagacccaagatcaagtctcacatctgcctctctctctctctgtcatgaataaataaataaaatctttaaaaaaaaaaaaaaggctatcacagagttggagagagagggacaggagtaggccatgttacaatgcacaaacttgtactgttcttatgtagtttagcagttcttcccaaagaaataagctgtgaattgttgcacaacattgtttaatttctagagttgattgattttggcaataagcccagtattttccttgccttttttttttttgtatattttttatttacttttttggagaagtgtatttacgcagattcttactctgccaatcaggaagttctaccttaaaggtaaatttgtacaatgttattttgatgtttctctgacatttccagtaactggtatatgctatacaagaaactgaaagtagcttcagtatttgtttataactcaaaatgtttttttaatgtactgtaaagttggatttttgattacacagtaaattaactcaaaaatggtcttcttcggggatccctgggtggctcagtggtttagtgcctgctttcgacccagggcatgatcctggagtcccgggatcgaatcccatgtcaggctccctgcatgaaggctccttcttcctctgcctgtgtctctgcctctctctctgtgtctctcatgaataaataaataaaatcttttaaaaaaatgaccttcttcattaatactagttcatccaaagctttgtataaacatgttattttataaattgaatgtgacaacctttaactttaactaatatttgcaagcctgtgaatctttctgtgcattgttttagtggtttttcaaaacccaaactctaaaccgtttgaagaattctttcacatatgaatcattacaatgtccatttgtacacttttattttaaaattatttactggcaaagtatactgactaatctctggcagttcctctcccaatacttggaacagagagttaatatttgtgcacatgccttaggaataggggttgggggcagatggacaagttggcttcccatggcaggccctttccctgcacacatgaaaacctcctcttctccacaactttagccactaatgccacttctgctgctgctgccaatgtcactgtcacatatctgggcccagttcaaagcccagtcacttccctggccccatggtgttctgttctgccacaggtatttgggaatgcactgggccaatcactgttggtgcaccgatagtgttacctggaagcctgagcccactgtgtgtggactgctgctggaacacaaatgcttgcatgtactgtgaatcaattcactgctttctctgctcatatgcatggtctattgtcttactggacttcatttataaaacagatattcaaagataaacttacaaaaaattcaatataatgaaagaacattataccaaggatattctcagcactgagccctgaacagctgcataaattgcatatctatgaagccagtcctgcacacatccttttcatgaaaaatgtcattgcaggattttagtggttacatatgcagtatatgtgtagcactatgaggactaacataagaatacatggatataactagctttgtgggcccacatctggggctgaccatgcagaatctttgcaatttcgtaggtctgaatattcccattagagttataatgacttattggggcaagagtcacacaaataaaaaccagtctatctcttttatcacctatgagattaaaacagcagctttcctattgtcagttctaataatagtctctggtaaaatatttgcaattagtccttatacagattttgtatctgaaattcttaaattagattgcatgactatatattttgtaccagattctaatagtatagtgagtgtttcaatgtatgattaggaatgttaaaatatatttgttcaaactttgcttctgttttgtaccaatatccatttttattgttgtgttgacaatgttatattcatttaaatttttttattttgtcttgcttttatttaatagtatttttaattcagtgtttttgttttcagaataaaatatattttgtaggatttcattcaataataataatttattcctattgccttctatgaatagtgacaaaatcccactttatttatttggttgtttctacatgttcaggatttttgaatttgtaggtactgtataatatgttattctaatgaggtttttttttttttgcagaaaacaatgttaaaaattgtgaaaaaatgtagtaaaaattccttaacatttccccataacttttgcttgaaaattaagaatttcttatactttcacgttgtttatgataaaatatattctattttaatcctccatctaacttagtatccattctctaatataagaacctattctctaattagaaaaataactccttcatgtgaccattaagattttgattaaatgctatcagtggattgaactcatgacttttttggaaaaatacttaataaaaagaaagatctcattattaaaattcttttttatatagagtcaaatatggtactttacaacttcaaccatttatttctaatcctaacagttgaaataatggaagagagagaaaatcttcttttaatgacaagttatcaaaataatcaaatattttacatgtaactcaaatactgtggatttctctgttaaatattatttatactgttaattttagagacatgttttcagaacctttataattctgggaataatatacttgatgaattgtagtttgtcaaaatctctcttaaatatgttgcttagaagtaaatataaaaagtgaaaagtggtctgccctggtggcccagtggtttagcaggaccttcagcccggggtgtgatcctggagacccgggatcgagtcccacatcaggttccctgcatggaagcttgcttcttcctctgactgtgtctctgcctctctttttttctctctctctctgtctgtcatgaataaataaataaaatctttttttaaaaagtgaaaagtaaacaaaagagactattacatttttaacctccaattctgtttttataatgaagttagagcctgcttatctctgttataatcatcattcagaaaccatgtcaaaattagagtagtaaacacttaagatatcatgattttacatatttactaacttaccactatcacgatattcctttatgaacagagaaataataatgatgaaggtctctaggagtaagaggcaattgaagtttgtatctactccagggtggaactctgaaaaatcaatgccaaagaattttcttattaacatccagaccatcttattgctgtttctttcttttttttttttttttaaatttatgatagtcacacacacacagagagagagaggcagagacacaggcagagagagaagcaggctccatgcaccgggagcccgatgtgggattcgatcccgggtctccagaatcgcgccctgggcaaaaggcaggcgctaaaccgctgctccacccaggattcccttattgctgtttctaccatacaagttttattctatacttccagtaacctataggtctatgaccaagtttcaattttcagagataaagctaagcaattttcagagataaagctaaggagatgacagcagccactcagaagacagcatgggattgaatatctcagggtgggccaaaggttagggagatgctcattccatgagttttgaaaaattcttgagtgtgaacacttcacagtaaatgagggaatatctgtcaagtttcagggctcttctcatcactttactatactctatggagccaaaaatgatatagccagactttggtccagaaaccaaatcaagtctaatatatatttttggaagatttgtgatttcaggatagatttcagtttttaaaatcagacatgtgaaaaaaatgctccacatcacttgtcatcagggaaatacaaatcaaaaccacgatgtgataccaccttacaccagtcagaatggctaaaattaacaagacaggaaacaataagtgttggcaaggatgtggagaaaggggaaccctcttacactgttggtggaaatgcagctggtacagcccactctggaaaactgtatagagtttcctcaagaagttaaaaatagagatacccttcaagtaatcaatttcactactgagtatttacctcaaagatacagatgtagtgaaatgaaggagtacctacaccccaatgtttgtagtagcaatgtccacaatagccaaactgtggaaggaactgagatgtccttcaacagatcaatggataaagaagatgtggtatatttatataaaggaataatacttggccagcagaaaggatgaatacctaccatttatatcgacatgaatggaaatggagggtattatgctaagtgaaataagccaataacagaaagagaattatcatatggtgtcactcatatgtgaaatacaagaaataatgcaaggaaccacaaagaaaggaggggaaagtgaaggggaaaaatcatagaggaagccaaaccatgagagacttttaactctgggaagcaaactgagagttactgaaggggtgggttgttgaagggtggatagggtaactgggtgacaagcattaaggagggcacatgacatgattactaagtgttatatgcaaatgatgaattattgaaaattacctctgaaactaaggatgtactatatgttggcaagttgaatttaaagaaaaaaaaagaaaaaacaaggtaaagtcattgaaaaaaagaaaaaagtgatgcaaaaataatatgaaattcaaatgtcagtgtccacagaactcaactatgttcaatcatggtgtatggcttataactgcttttcactacaataacaaagatgaggagttgtaatcaagacagtttgtagtgcagtgatggagttataacatcatttgagtcacttgactataacaatacaactacattttgtctttgttttattaccagggaataccagtcatgccaaaacaagaaaagaagggaaggccaaagtagactttgaaaaaaacatcttaagttatattggagtggattattttcttattgaattacatgtattcattatgcaatgacactatagcaagaaaacaacagagtgagaaaatggtggcagactagcaggaccccaggattgcttccacctatgaatgcaactggtaactatcaaataatcttaaataccccagaaactggcctgaagacaagaaaaaattccacaactaaaggtagataagataccacattgaagaatttaggaagtgcatagacataatttaaggaagaaatgatccctggcttctatacaggggaggaagctctgtttatgaagaaggataagagagtgacagagagagaaagagagagagtgagggagagagagagagagagagagagagagagagagagagagagagagaacacacagaggaatgaaccaggagaaaatttcccatagtcattggcttggaaagcgaaagtggttaaatttcatgaattcttgccatcaaaggggactaacctgaagtattaaatgtcagggagcttggctccagtaggtcttgaaggcactggggctgctcttggaaagaaggcaaacaattcatagagatgcagcatggaaacagtgatctgaagagtacctggggtgcacagtggggaaattatttccccccctcagagtgtgtccctgagagggagagttcacagagacacctctccaaaaacaaaggaactagctggcatcatttccctttcctgtcccttatcagaagcccatggccacctgtgggaactagcacaataccaatactgactgcctaactggcatacaccaagcctcacaccctgcactctagtagaacttcctttctcagccaagctggcctcagtcccagcatgacatgtcattcccccagaagacagcagaaacccttgcccacatgatttctcccaaccagagaagtatgcagggcctcctctggtggaggaagtaacaggttttatttcaccaatagaccacaatacacctagttaaactcactatattcagaccagggaccaaacacttgccacaggcaaggagagcctctgaagaccactgcttgaagaatagagcagtcagagcaaaactgtacagcacatgcagcacaaagtggagacacttcctaaagcaccaggccctggaaattacatgccctcttcttcataagccattattttcaggagcaggagacataactgggttttctaacagagagaaggtggcagagatttaggcaaaataagaagacaagaatttctcccaaatgaaagaacaagataagaccaaggccagagatctaaataaaacagatataagtaacatgcatgatggagaatttaaaacaatgattataaggatactcactggacttgaaaaaataatagaagacattaagagggaaaatggcagcagaataggaccataggctcatctcatcccatggacataactagataactatcaaatcatcctaaataccaaagaaaccaccatgaagagtgacagaactaattccacaattaaagggagagaagaggacaccctaaaaaagtagcaggtgcagagatatggtttatgggagaaatgaatagcaggtgctgtggaaatcagagagagctgtggtcaagagaaaggcaaggaagaaaggaacacacagtggaatgcacaaggagaatgtttctccaaatccatcagcttgggaaatgaaagaggctaaatttcatgagttcttacaatcagtggaactggagttttaaagttcagcaggcttgggtgggatagagacctgaaggcactgccctgcttctggaaagaagacaggcaaataacctgggggacagagagtgtgtaaaaagagatctgaaaaacacctggggcacacagtggggagattattcactcttttttgaagcatatctctgagaggcagcattcacagagacaatctctgggaacaaagaaactggctgtcaccatgtctctgccctgcccctcagcataaacacaaatccaccttgggaagcagcacaatgctgacacatctacttaacttgctcattaaagcctatctcctcgcactctggcaggactgcctttctcagtcaagcttgcctcagtctcagtgtagtggcccctgccctagaagaccagaacaaactactacctacatcacatttcccaaccagagagttttgtaggcctccattctggtggaagtgatgtcaattatcccatcacaagcagaccagagcacacttacttaaaacttgccacattcaggccagagacaaagcactgcccacagaaggcaagcagagcctctgtagatggcaggcctgaaggatagtcagccaaaacacaataacagagcacacaaagcacatataagaaacatttcctaagttccaggccctggacactacgtgatctcttcttcattaagccaaaattttcaggagcaggagacataatttctaacacagagaagggagaggcttagacaaaattcaaagatggaaaaacttatgccaaatgaaaggacaagataaggtcacagccagaaatccagagcaaaacagatataataacatacctgatggagaatttaaagtggtacaagtatactcactggggttaagaaaagaatagaagacaagacaaaaaggagattcttaccacagatataagaggttaaaaagagttgatcagagatgaagagtgcaatcaattatattggatacagactcgattcaatgaacacaggctggaagaagcaaagggacaaattagtgactagaagacaaaataatggaaaataatgaaggtgaacaaaagagagaaaagaattatgcaaagtgagaatagacttaaggaattcagttactccatcaaacataataacattcatattataggagtctcaaaacaagaagagggagaaaagggagaacatttatttgaagagctaatagctcataccttccctattctggggaaggaaacggacatccagacccaagaggcacaattgggtcttgatggcagaactgccatcaaacacgacaggagttagaccaacagtaacacatattgtcactaaactggcaaaacatagtgataaagaaaaaatttttaaagcagcaagacaaaagaagaagtaacatagagaggaaaacccataagactagcaggagatttttcagctgaagctttccaagccagaaggcagtgccatgatatattcaaagtgctaagtgagaaaaatctgtagccaagtatactctatccagcaagggtatcttcagaatagaaggagagagaaagtttcccaggcaaacaaaaactaaaggagttcatggccactaaaccactcctgcaagaggtattaaaggggactgtgattggaaaagagagaccaaaagtgacagtaaaaaagtagaaaacacaaaatagtaaaaatgcatatatctataaaaaataagtaaaaactcacaaaaaggatataaaatataataacatatacttaaaacatggagaggacaagagaaaagaatgtcttcaaactaaaatgaccataaactgggcggggcaagatggcagaagagtaggagggtccccaagtcacctgtccccaccaacttacctagataactttcaaatcatcctgaaaaacctatgaatttggcctgagttttaaagagagaacagctagaatgctacagaaagaagggtttttgcttctaacaaggtaggaagattgaaaaaacaaaaaaaaaaagaatcaagtgggggaggggcccccactaggagctaggctaacgctgggtggcgaaagcctctgggacaggaaagcccagaagtgggaactttaaaaattcacaccagattctttccctagaaagaagaactcatcacaaaagaaagaatcaaaaacagtactctctgccacagagttacagaatttggattacaatctgatgtcagaaagccaattcagaagcaattataaagctaccagtggctctggaaaaaagcataaaggattcaagagacttcatgactgcagaatttagatctaatcatgccaaaattaaaaaatcatttaaatgagatgcaatccaaactggaagtcctaacaaggaggattaatgacatagaggaaggagtgagtgacatagaagacaagttgatggcaaggaaggaggaaaaaagagaaaaacaattaaaagaccatgaggaaaggttaagggacataaatgacagcttcagaaggaaaaatctacatttaattggggttccagaggacgctgaaagagacagaggaccagaaagtgtatttgaacaaatcatagctgagaacttccctaacatgggaagggaaacaggcattcagatccaggagatagagaggtccccccctaaaatcaataaaaaccgttcaacaccttgacatttaatagtgaaacttgcaaattccaaagataaagaaaagatccttaaaacatcaagagacaagagatccctaacaattatggggagaagtattaggttaacagcagacttctccacagagacctggcaggccagaaagggctggcaggatatattcaggatcctaaatgagaagaacctgcagccaagaatactttatcagcaaggctctcattcagaatagaaggagagataaacagcttccaagataggcagaaactgacagaatatgtgacctccaaaccagctctgcaagaaatattaagagggactctgtaaaagaaagaggatacccaaagaaataagccacaaaacagggactgaatagatattatgatgacaataaattcatatctttcaatagtaactctgaacgtgaatgggcttaatgatcccatcaaaagccgcagggtttcagactggataaaaaagcaagacccatctatttgctgtctacaagagactcatttgagacctaaggacacctccagcctgaaaatgaaagttggagaaccatttaccactcaaatggtcctcaaaagaaagcaggggtagccatcctcatatcagataaattaaagtttatcccgaagagtataataagagatgaagaggaacactctatcatacttaaagaatctatccaacaagaggacctaacaatcatgaatatttatgcccctaatatcggagctgtcaagcatatcagtcaattaataaccaaagttaagacattcttagataataatgcacttatactgggagactttaacatggcctcagtgtccatcaaaagatgaatggttaaagaaaatgtggtctatgtatacaatggaatattcctcagccattagaaatgacacatacccaccatttgcttcaacgtggatggaactggagggtattatgctaagtgaagtaagtcaatcagagaagggcaatcatatggtttcactcatacggagaaaataaaaagtagtgaaagggattataggggaaaggagagaaaatgaatgggaaaaatcagagaggatgacaaaacaggagagactcctaactctgggaaacgaacaaggggtagtggaaggggaggtgggcaaggcgttggggtgactgggtgatgggcactgaggcgggcacttgagggttgagtactgggtattatactatatgctggcaaatcaaactccaataaaaaattatacatagtaaaaaaaacaccctcccaataaaatccagttaaaaagtgtgcagaagacacgaacagacatctatgtatatatacatatacatacatttctccaaatacacacacatacatacattcacacaacggaatattattcagccataaaaaggaatgaatcttgtcatttgcaacaatgtgaatagatctaaagagtataatgctaaacaaaataaatcagtcagagaaagacaataccatatgattccactcatatgtggaatttaagaaacaaaacaaacaaacaaaaaggaagacaaatcaaaaaacaaactattaactatagagaacagagggtgaccaaaggggagattggtgggaggataagtgaaatagatgatgggggttaagaatacacttatcatcatgagcattgggtaaagtatacaattgttgaatcactaccttgtacgcctgaaactaatataacactatattaacgatgttggagttagaattaaaaacttagtaaatattttttaaaaacaaaaaggcaacctactgagggggaggagacattgcaaataatatatatgataagtgactaatatccaacatatataaagaacttatatgcaactgataaattactgaactctacatctgaaactaatactatatgttaactaattgattttaaataaaaataaattaaaaaaagaacttctacaactcatcaccccccttccccaaaaaattcacttaaaaatattcagaggacctaaacagacatttttccaaagaagacataaatggccaagagacacatataaagatgctcaaaatcactaattatcgtgaaaatgcaaaacaaaaccacaatgggctatcacctacacctgtcagaatagttaaaatcagaatgataagatatagcaagtgttgacaagaatgtggaaaaagaatccttgtgaactattgatgggaactaaattgctgcagccactgtgtaaaaccatatggattttcctcaaaagattaaaaatagggacacttgggtggctcagcatctgcaccatctgtctttggctcagggcatgatcctgcagtcctgggatcgaatcacacatcgggctccctgcatgaagcctgcttctccctctgcctacatctctgcctttctctgtctctgatgaataaataaataaaatcttttaaaaaagcattaaaaacagaactaccctatgatccagtaattatactattggatatttacccaaggaaaatgaaaatagtaatagaaaagatatatgaaaacacccctacgtttattgcagcattatttacaatagccaagatatggaagtaacccaagtgtccatggatagatgaatggataaaaacgtgatatctgtctatcttggaatattgctcacctataaaaaggtcaagatcttgtcatttgcaacaacatgggtggacctacagggtataatgcttagtgaaataaaccagtcagagaaatatgaacaagttatgatttcactcatatgtggaatttaagaaacaaaacaaatgaataaataatgaaaaaagatagataaacagactcttaaatatagggaacacagtagtggttgctgcaggggtgatttatgggggaaagggtgaaatagataaaggggttatgagcacattttttttaatgtttcaactttttatttaaattctaactagttaacatatagtgtaatataatttcagaagaattcagtgattcatcatttacaatacccagtgaaaagcacacttatcttgagtactgagaaatgtatcaaattgttgaatctttatattgtatatctgaaactaactttatgtctttactatttttctttttttttttctttactatttttcaattaaaaaaagaaaaagagatgattacctaccaaaaaggttttgcagaaaatactgctgaagatcatcatgtagtcctatatgtcattcagatgatttaaatttttttaaggacaagtgacttaaataaatgagataaatacaaggatttaaatagctgagatatagttattcttactcaattgatctggctattataatacaactctgttatatcctcatttctttttgttttatattttcatctttcttcttgctagagataaatctttgtttttttctcagccaaatgcctgataaggaggcttggatttatgtacataatcaccattggtactatttgagcaggaggcttttgtccggctgtcctcctaagtactttggccatctttggattgttacttttgatgttgcatctcatcttcttcctctaaaataggaagaccagactacttgcttttgttttagctgtcatgtatagtaacactaattctccatttgttgtacatgccctcgtagaggtcaataatagtgacttattgctaactcagctgctcatttttcaatgtccttaaatattctacagcaggtatgtctaccactccattcttttttgaaatgtaacttgatttgtatttctataaaacattgtttcttatctccccacccccaaactctcattctctctctctctctctctttttttattggagttcaattggccaacatatatagcatatcacccagtgctcatcccatcaagtgcccatcacccagttatttatttttgtcctcatatttttccactactgaatattactttgacattaagcaaaggattatatatgacatacataaaatcataattaagacaatgagaaaaattgtcttaaatttcaaaagtgatatggaattattactgagaaagagaatatgacaaactatatttcctattctgttatatatgcctaaaattctaaataggttagtcaatagtagcaaaaatgcctctgtgtaagacatggtcttgtatataaaacaagaaaacataggagaaattgtacacaactatgtttcacacagcttattgtggaaaagggaaacactttttttaaatattataaagcaaataaaaatggaaagtaaacatcaaagtagtccaatgccatattcttgcaagaagcatttttagagtataatataaatcttatgcaagtaataacttgaatgatactccactggtgaacaatttccattttgcatctggacagtccttgattattttcccaaccataaaaagttactcacgtattgacagtcttagtaaatatcaatttttaaagtacttactatgaatcagaattataatcagtataggttggatcctactctagtcctaagacccctagttggtgcaccttaaaattcattcactatgaatattaatagccttttagaattctacagcaatatgtttctttaaaaaagcttttatttcattattacacagagtggccagtatgagagtatcagtttttaatcctattgtgtcatctttttcaacttttagaatgtaaatatcacatatattaaatgctaattcttggacatatttttgaaataaatgacattctaatgacatatagaaaaggatggattgaagtgagctaggagttggaattgtgaggttagagagtacagcaaaatttaaactacatagaaaacatctcacctgggagcattactgatagaagagaaaaatatagggacacagagattctccaaaattagagtgcatgggtgaaaatgaaaaaggagaatctttcttcttattggaaagaaatatctaatgagagaggttatcaaactgagaactttgggaccatttataattatggagtgagaagaaacgagatgtcaggttgaccagacctgacagaataatagattcaactcttagctattgcaccctggtgtctgctctatctttgtggctcaaatacttttcttaggaacattagacatgtggacttatacacacacacacacacacacacacaaataataatagcagtaaacaagtaaaacttactattttgtgtctcattattcatacataaatttgtatcttgacctatttgctgagtcaccatttcaggaaggagttcttttcaggtcgttcaattgtaatctaaaggaaattcccaactctattctgagctgtgttggcaggattctgaaatgtctttgtgttccttatacaagcacagaaatgagtgattttaccacccagggcaaaatcctggattagacagaagctcagtcacatgcaccagtagcatgaaggtatcttaacactgctctctgtagctaggtggaatatggacttattccagaagcaagggtactctggactttggactttatagactcataaaacattttagttgcaattgttcatttagtcatttgaatacatgcagtttgtttgtttgtttgtttgtttgtttttggtctctgtctagatctccagtgaatagaagtggtaagtgtggatatcctttttgttcctgaacttagaggaaagattagatattttcattatttattatgatattattttcataaatggccttcattagttgaaaacattcccttctagtgtgttaagtgttttgttttttaattaggaaaagacattggattttgtcattttttttcttcctttgaggtgataatgtgttttttctcatcattctcttaatatcgtgtattatattgattggtttttgtatgtatgtaaaaccttttttaaggtttttcttaaagttttgaaaagctattagccagaatcatggagtaataagatacaatatttttccttttttaaaaaagtgaatacatgtgtagagttaagaagctattgcacatttatgatttaataaaataattctaaaggaaaaaaaataaggtttttacctgccaagtacaatatctggacttcctcaggaacaattgctatttattttttcccctatgtattaacaatgctttctgcttcattgcttgcttcatgactcttttgttgaaaactagacatttctagtgaaggggaccataagagaatggggaaactaagtgcaaaaaattagagaggaagacaaaccatgagagactcctaactcttggaaacaaagggttgcaaaaagggaggtgggtggggggatggggtaactaggtgatgggcattagggaaggcacatgatgagatgagcactgggtgttatatgctggtaaattgaatttcaacaaattttttaaaaaagaaagaaaactagatatttgaaatattgtgatgtttcaactctagaaatgttgttgctgcttgtatgtttatttaaagacttttttaaaagcctaattcctcaaatttacatttttgtttgtttgctgtagccattgaaatctcattcagcttgcttggtcattagctaatgattgaacagagaacatttttggcaccaaaaagaaatcccagtctttgacaaggagctgtatgtgtatattgaggctgtacatgtacattaagtgctcaggcaggcagtttacagcacgccttgttttcactttctgcttgcatcagggtcagcaataagtgaaagatcaagattgttttcaggtcttttctgagcatacacacaactatacagagtctctagctgagcctacaacatagctgtgcagattctcagagccatatgggagcttttgaaagactatataggggcagcccggggggctcagtggtttagcaccgccttcagcccagcgcctgatcctggggacctgggatggagtcccaggtcgggctccctgcatggagcctgcctctcccctctgcctgtgtctctgcctctctctctgtgtgtctctcatgaataaataaatacaatctaaaaaaaaaaacaagactatatacatcccattcctcaaactttatacatttccttctccaggtctagaattagtacttctctaagaaagtttgatttgtgttaataagaagtaatagtaaatgaccaaaattgtacactttccattttaatcccatatgtaaataattgtaaattatcactacaagaaaagttgaacaacaaattacttttcttctagtcatcaaagaattgaggttgcagagcaaaccatactttcttcgccccctcatgtccagaaagacatggctctacaattttctcaggactcctataacaaagtaccacaaagtaccacaaagtcacatgagtgactttactcatttttttaaaagattttatttattcattcatgagagacacagagagaggcagagacataggcagagggaaaacaggttctcttcggggagcctaatgcaagagtaaatcccgggaccctgagctgcaacctgagccaaaggcggacgctcaaccactgacccacccaggtgacccatatctttacttttcaatggctttttacctcacagtattatactatatttagccctataggcacaataaaattttaaattattagcctgactaggctgttttcctacttaaagataatcaaatatgaagaaatattcctcaaatttatagattcttgtgattcaaaattcaaccaatattcatagcatagtattcaaaatcttaactatctctaaattggggaacaaggcatggaaacatattccaacacaaacacgccctgcacagccatacttttcctatttaagaaaagtttttatctttattaattttgtagtaactgtgcatggttatatttccccaaaacatattttttaaaaattttatttattcatgagagagagagagaggcagagacagaggcagagggagaagcgggctccatgcagggagcccgaagtgggactcgatacggggaccttgagatcacaccctgagctgaaagtagatgctcaaccaccaagccacccaggcatcccccaaaacatatttaattaaaagattgtaaatctggcaaagatcaagaattttgcagtaaatatctatatactcacaatctaatttctatcgttaacatttaactccatttgtttattaactctgcatccttctatccattcatttatcaatccattcagtttgacatcactaataaaaaacttcagtactcatataattaactataattattgatttgttttcaattttttcttttttttaataaatttattttttatttggtgttcaatttgccaacatatagaataacacccagtgctcatcccatcaagtgcccccgtcagtgccggtcacccagtcacccccacccccggcccacctccccttccaccacccctagttcgtttcccagagttaggtgtctctcatgttctgtctccctccctgatatttcccactcattttttctcctttcccctttattccctttcactattttttatattccccaaatgaatgagaccatataatgtttgtccttctccgattgactgatttcattcagcataataccctccagttccatccacgtcgaagcacatggtgggtatttgtcttttctaatggctgaggaatattccattgtatacaatttttttcttatgatgttaaatttacatttgatgacttcgtgagaaaaaccagctctgctctgtagtatctactgatttctgtgacacaaatactttcaccatggtcagcttcaagctaccaattgtgttatctctgaaagcacataaatgatgcgcataatcaactctcatgtcgttttgtagatttaaaaaaaaattactttgagaataaccgaggaatggaattgctgggttagacttcaggtttatggatataatttaaaagaaactcctatatcttattccaaagaaccagtttttccaaagttccatttcacactccctacaaaatatataagatctcgttagactttttttatttttgccaattttattcttcctggtgattgtattctgctttgaattaacatttcttagatgactaataaagttgaacatgactttttgtacatgttggcaatttggatatcttattttttgaaatatctttttaaaactcagccgatttttatcaggtcatctgtttttaaattgtgtatgctgtagaaatctttatctttggatataagtattttatcagttatatattttgaaactcttttctctcaatctgtggtttgcatacttattttattttgtgtcttttgatgtgcaagaagtttaaatttttattaagtttaatttatcattttatcttctgtgattttatatctggaaattgttagaatgtgtttgcctattttaagttataaagaaagatatgtacttatatatactctaaaaatgttatgtcttaagcgtttatgcttggatttctaattgcttttattcttatgactctgatttttaaaagtattgttgactataatatgaagcagagatgaggactcttattttttaaaatacagatatctacccaaatttggggggaacattttattgaaaagatgttttttttcctctggaatgctttggcttctttgtcaaaattcaaataattatatatgtgagtgacaatttcaattaaatatatatgtttgctgattcttacattagtgccacaatttctagattactatagctttattataagtaattaatttggatgtctttgggtttttaaatttattttagatattctagatgctttgcattccccaaaatttcacagttggagtattgtaaatttttgtactatacatgaaattgcaataaaaactatatatcattggggggctagattgacatttaaactatcttgatactgggatacctgggtggctcagcggttgagtgtctgcctttggctcagggcatgattctgggatccgggatagagttccacatcaggctccccgctgggagcctgcttctccctctgcctatgtctctgcttctgtgtgtgtgtgtgtgtgtgtgtctcccatgaataaataaataaaatctttttttaaaaaaatcttgaatcttgcaaatcatgatcttaatatatttatccatgcatttaggtcttcttaatatctctcaccttatttttgagttttaaaaaaggattatatcaagagttataaatggttatattacataccaaagtaaagcatttgtcactttattattttttatcatttttatttatttatgatagtcacacagagagagagagagaggcagacacaggcagagggagaagcaggctccatgcaacgggagcccgatgtgggattcgatcctgggtctccaggatcgcgccctgggccaaaggcaggcgccaaaccgctgcgccacccagggatccccatttgtaactttattaagtaaatggaacaaattaatcattaaggcaaaggcattctgaaaaataagtagacacaagacatattaagaatttttttgtgtgtgtattttttattggagtttgacttgccaacatatagcataacacccagtgctcatcctgtcaagtgcccctgctcagtgcctgtcatccagtcaccccagtccccccgctcacctcccttccaccaccccttgttcatttcccagagttaggagtctctcatgttctgtcacccccattgatatttcccactcattttctctcctttcccctttattccctttaactattttttatattctccaaaagaatgagaccatataatgtttgtccttctccgattgacttacttcactcagcataataccctccaggtccatccattttgaagcaagtggtgggtatgtgatgtttctaatggctgagtaatattccattgtatacatagaccacatcttctttatccattcatctgtcgatggacactgaagctccttccacagtttggctagacattgctgctataaacatcggggtgcaggtgtcccagcatttcactgcagctgtatctttgggataaatccccagctgtgcaactgctgggtcatagggcaggtctgtttttaactctttgaggaacctccacacagttttcctgagtggctatagcagttcacattcccaccaacagtgcaagaggattcccttctccacatcctcttcaacatttgtggtttcccgtcttgttaattttccccattctcactggtgtgaggtggtatctcaatgtggttttgatttgtatttccctgatggcaagggatgcggagcattttctcatgtgcttgttggccatgtctatgttttcctctgtgagatttctgttcatgtcttttgcccatttcatgattggattgtttgtttctttgctgttgagtttcataagttctttttagatcttggatactagccctttatctgataggtcatttgcaaatatcttctcccattctgtaggttgtcttttagttctgtggactgtttcttttgctgtgcagaggctttttaccttgattaagttccaatagttcatttttgcttttgtttcccttgccttcttagatgtatctaggaagttgttgtacacaagctaaccttgcacctaaaggaactggagaaagaacagcaaataaaacctacacccagcagaagaagagagttaataaagattcgagtagaactcaatgaaatagagaccagaagaactgtagaacagatcaacaaaaccaggagttggttctttgaaagaattaataagatagattaaaccactagccagccttattaaaaacaaaagagaaaaacgttagttaataaaatcatgaatgaagaagggagatcacaaccagtaccaagtaaatacaaatggttttaaaaatgtattatgaatacctatatgccaataaattaggcaatctagaagaaatgaatgtatttctggaaaaccacaaactaccaaaactggaacaggaagaaatagaaaacctgaacaggctgataaccagggaggaaattgaagcagttatcaaaaacctcccaagacacaagactccagggccagatggcttcccagaggaattctagcaaatgtttaaagaagaaacaatacctattctactaaagctgttctgaaagttagaaagggacagaatacatccaaactcattctatgaggccagcatcaccttaattccaaagccagacaaagaccccaccaaaaaggagaattatagaccaatatccctgatgaacatggatgcaaaaattctcaacaagatcctagccaatgggatccaacaatacactaggaagattatttaccatgaccaagtgggatttatccctgggatgcaagtttggttcaacactcataaaacaatccatgtgattgatcacatcaacaagagaaaaacaaaaccatatgaccctatcaataaatgcagagaaagcatttgtcaaaatacagcatccattcctgatcaacactcttcagagtgtagggatagagggaacattcctcagcatcttaaaagccatctacgaaaagaaaagcccacagcaaataccattctcaatggggaaacactggagcctttcccctaagatcaggaacacgacagggatgtccgctctcaccactgctattcaatatggtgctagaagtcctagcctcagcaatcaggcaacaaaagaaataaaaggcattcaaattggcaaagaagaagtcaaactctccctctttgcagacgacatgatactgtacctagaaaacacaaaacactccatcccaagattgctagaactcatacagcaatttgtccgtgtggcaggatacaaaatcaatgcccagaaatcagaggcatttctatacactaacaatgaaactgaagaaagagaagttaaggagtcaatcccatttacaattgcatccagaagcataagatacctaggaataaactgaaccaaagaggtaaaggttctatatcctaaaaactatagaacacttctaaaagaaattgaggaagacacaaagagatggaaaaatattccatgctcatggattggaagaattaatatagtaaaaatgtctatgctaaccagggcaatgtacacgttcaatgaatccctatgaaaataccatagattttcttcaaagagttggaacaaatcatcttaagatttgtgtggaatcagaaaagagcccgaatagccaggggaatattgaaaaagaaaaccagggccggacgcatcacaatgccggatttcaggttgtactacaaaactgtggtcatcaagacagtgtggtactagcacaaaaacagacccatacatcaatgggacaaaatagagaacccagaaatgggccctcaactctatggtcagtcattattccacaaagcagggaagactatccactggaaaaaggacagtctcttcaataaatggtgctgggaaaattggacatccacatgcagaagaatgaaactggaccattctcttacaccatacacaaggataaactcaaaatgggtgaaatacctaaatatgagacaagaatccaccaaaatccttagaggagaacacaggcaacaccctttgggaacttggccatattaagaattcaattcactaggaatgaacacagttctgaacttctttgtgtcaaatattaaaattaacatatacgactacagttgaaagaatgcaaaatttataaaaccaggatcactgtaatgggttttattaaaatttactctatatttataaatttagtagatattatttaattgaagatgtaggaagattccaataaaaaatataacaagttagatattgtaatttcattgatttaggttacatctaaaataacattcttagatttttgagttttggctgatatatacaactctgtttctacaaacccaaaaaggaagagaatttttatcattccagatagcttccttatgcccctttccagtccactcctctaccctgaagcaaatattgttttgatttcattcaccataactgtttaattttaaatctaccagaaaattgtttttttttattggtattatttcattatgttaatatatgacaaatgtttatccatttacctaatgacatttatgttatttctagtgtttgacctttatgagtaattctgccctaacactgttgtacagctcttttgtgggtatttgtttatattttgcttgggtaaatatcatgagtgaaattactacctcatagcagagaaaaaagcttaaatttgtaagacattggcaaattgacttccaactggttgcaccattttatatccccaccattggtgtttgaatttatcatagtacaatgtaaaaaccagggaattaccatggataccacccctcacatcttattcagatttcaccagtttcacctgcacttgtattcgtgtgtgtagttccatgcaattttatcacgtgtgtgaattcatataaccaacagctcaatcacaacacagagcttttgcatcactacaatggtttccctcatggtacccctttaaagccatactatattttcatgttcattcttttcccagctcctaactcctggcaataggtaaactgttctccatctttatgatataaccgttttgagaataagtttttctgagcatgcatattgagaaaggtgaagaatttggaccattagtgaaattaccatacaactcaggaatacagcacattagaaagtgacaactactgagggaaaagaaaatattagcaataggtggggactattgacagctgcaagagagaatggggttcaatttgagtgggtcaaacagggctttgagagaagataatacctgagtaagaataggagaggtcagggagttatctaagtggatttctggaagaagaaatttccagtcagaggaaacaactacaacaaagtctgtaagataggaacatgcctgctgtttttaaggaatggaaagaggctgatttgactggtgtaaaggagccaggagtataataattgaagaaaaggtcagaaaagtaacaaatcatataacatgcacataatattataccaacattattagatataagaatatatttaagaaccaatgcatttctttagaaccaaaatatacagaacatacaatttaaaaaggtatgtaattcacattatcatcagcatcataaaatacttaggaatagtattcttatatattttggtaaactcattaaaaaataaaataataaactcattaaaaataattaataaactcattaatgccaataatttgtggaattttttgtagttgctaaataattattcacttgaataaatactaagaaaaaggctcaaaacttcagtatgtttaagttcaaaatttatgtttaaaatacctattattaaaagagatataaatggtcacaaaattgttctatgagttcagtgaaatctcaaacaaaacttaaacataaaatttctgctttggatcaagaaagagtaacaggggtttcaaacaacaacaaaacggaataaaatatatgaaacaatgattattgagacattgggcatcagacatcaaaggacaatgataactgagagatggaaaacaagtgaggaaggccctacaattgtcccagctgacttcctagagagtttccaggaaccccagaagaatctacctttctttctgacttgtagatcaatttaggaattcagggaaaccaaagtggctagggtttgcaaagtgccagagaagaaataactgtacaagcagagggaaagaatatcacagagatctatagagtgctccccttaagtctccatgtgagcactgaacagtgtatatagatgaaactacccaaggttggagaaggaatcacctgggaagaattgggggaacagtcaatggaatccacacaaggtccagaatagtcctagtttccaacagttaaagtgaaaaacctcacaactcaagacatcaggtagagtactgaggacaattttactttagtagtggggagaatttagctctacactaaaaatagtttcagattctgcctaacaatcctaaaacaatacccaaaaggatcaaatcataccaagaaactgtgttttagaacaaacctcaaaactacttatggaatgcaaaaatatctatcatctaataagggaaattcccagtgtttgacatccaattgaaaattaccagccatgcaaagaaacaagaaaatatgacccagaaataggagaaaattcaatcagtagacaagtataaccagaaatgacatagatgagagagttattagatacattaaaaataaatataactatatttcatatgttcaacaagctagaggaaagattgaccatgttaagtagaaacatggaaagtatatgttaaaagactcaaatcaaaattctagacaggataactaaaatgtttggcatgaaaactatactagatgggattagctgcaggttaggcattgcagaagaaaagattagtgagttcaaagacagaatcaatccaaaatgagatactgagaagataggaagttggggaaaaaaataaagaatgcatcagtgagctgtgatataattcaaatggtccagaatgtctgatttgaagaaataatgtcctaatttttctcaaatttgatgcaaaacaaatccaaagatttgtatctctaccaatactaaaaacaaagaaaactaaaccaaatcacatcaaaatcaaatttctcaaaaccaatgacaaaaaaaaaaaaaaaaaatcttagaagccagagaaaaaagtaacattatataaagtggaatgaatataaaaatggaagcagatttcttacttaaaatagtgtaaaccaggtatgagaggaataatatttttaaagtatgaaaagaaaaaaaatcattgccatcttaaggtttatgtgatttcaagaaataccaagtaactaaaacaatcttgaaaaaaaataacaggggaggagcaagatggcggaagagtagggtccccaaatcacctgtctccaccaaattacctagaaaaccttcaaattatcctgaaaatctatgaattcagcctgagatttaaagagagaccagctggaatgcaacagtgagaagagttcgcgcttctctcaaggtaggaagacggggaaaaagaagtaaagaatcaaaggccttcgagggggaggggccccgcgaggagccgggctgaggccggggcgagtgtccccaggacaggagagccccgtcccggaggagcaggagctgcaccgaccttcccgggcggaaaggggctcgcggggaggtggagcaggacccaggagggcgggggtgccctcgggttctccgggacagtaacagaacaactgcgcgcccaggagagtgcgccgagctccctaagggctgcagcgcgcacggcgggacccggcgggacccggagcagctcggaggggctcgggcggcggctccgcggagggggctgcggggcgggagcgcgattccaacagcgcaggctccggagcacagggcgccgggacacagcccaggatccggcctcccccgggacaggcagagtccgggagggcccaggacagcgaggacgctcctgccccagctgagcagatcagcggccccgccccggagcctccaggccctgcagacggagttcctgccggagctgaatccaggtttccagagctgccccgccactggggttgttcctcctggggcctcacggggtaaacaacccccactgagccctgcaccaggcaggcgcacagcagctcccccaactgctaacacctgaaaatcagcacaacaggcccctcccccagaacaccagctagactgacaacttccaggagaagccaagggacttaaagtacacagaatcagaagatactccccggtggttcttcttttttttttgtttttttttttgtttttatttgttttttttttttttttttttttgctttttgatttgtttccttcccccaccccccctttttttctcctttctttttctttctctttttcttctctctttttttttcttcccttttttttctctttctcttttctttccttctttctctcctctctttttctctttttcccaatacaacttgctttttgccactctgcactgagcaaaatgactagaaggaaaacctcacctcaacagaaagaatcagaaacagtcctctctcccacagagttacaaaatctggattacaattcaatgtcagaaagccaattcagaagcactattgtacagctactggtggctctagaaaaaagtataaaggactcaagagacttcatgactgcagaatttagagctaatcaggcagaaattaaaaatcaattgaatgagatgcaatccaaactagaagtcctaacgacgagggttaacgaggtggaagaacgagtgagtgacatagaagacaagttgatagcaaagagggaaactgaggaaaaaagagacaaacaattaaaagaccatgaggatagattaagggaaataacagcctgagaaagaaaaacctacgtttaattggggttcccgagggcgccgaaagggccagagggccagaatatgtatttgaacaaattctagctgaaaactttcctaatctgggaagggaaacaggcattcagatccaggaaatagagagatccccccctaaaatcaataaaaaccattcaacacctcgacatttaatagtgaagcttgcaaattccaaagataaagagaagatccttaaagcagcaagagacaagaaatcctgacttttatggggaggaatatcagggtaacagcagacctctccacagagacctggcaggccagaaagggctggcaggatatattcagggtcctaaatgagaagaacatgcaaccaagaatactttatccagcaaggctctcattcaaaatggaaggagagataaacaacttccaagacaggaaggaactgaaagaatatgtgacctccaaaccagctctgcaagaaattttaagggggactcttaatattcccctttaagaagaagttcagtggaacagtccacaaaaacaaggactgaatagatatcatgatgacactaaactcatatctctcaatagtaactctgaatgtgaacgggcttaatgaccccatcaaaaggcgcagggtttcagactggataaaaaagcaggaaccatctatttgctgtctacaagagactcattttagacagaaggacacctacagcctgaaaataaaaggttggagaaccatttaccattcgaatggtcctcaaaagaaagcaggggtagccatccttatatcagataaactaaaatttaccccaaagactgtagtgagagatgaagagggacactatatcatacttaaaggatctattcaacaagaggacttaacaatcctcaatatatatgccccgaatgtgggagctgacaaatatatcaatcaattattaaccaaagtgaagaaatacttagataataatacacttatacttggtgacttcaatctagctctttctatactcgataggtcttctaagcacaacatctccaaagaaacgagagctttaaatgatacactggaccagatggatttcacagatatctacagaactttacatccaaactcaactgaatacacattcttctcaagcgcacatggaactttctccagaatagaccacatattgggtcacaaatcgggtctgaaccgataccaaaagattgggattgtcccctgcatattctcagaccataatgccttgaaattagaactaaatcacaacaagaagtttggaaggacctcaaacacgtggaggtgaaggaccatcctgctaaaagataaaagggtcaaccaggaaattaaggaagaattaaaaagattaatggaaattaatgagaatgaagatacaaccgttcaaaatctttgagatgcagcaaaagcagtcctaagggggaaatataccgcaatacaagcatccattcaaaaactggaaagaactcaaatacaaaagctaaccttacacataaaggagctagagaaaaaacagcagatagatcctacacccaagagaagaagggagttaataaagattcgagcagaactcaacgaaatcgagaccagaagaactgtggaacagatcaacaaaaccaggagttggttctttgaaagaattaacaagatagacaaaccattagccagccttattaaaaagaagagagagaagactcaaattaataaaatcatgaatgagaaaggagagatcactaccaacaccaaggaaatacaaacgattttaaaaacatattatgaacagctatacgccaataaattaggcaatctagaagaaatggacgcattcctggaaagccacaaactaccaaaactggaacaggaagaaatagaaaacctgaacaggccaataaccagggaggaaattgaagcagtcatcaaaaacctcccaagatacaagagtccagggccatatggcttcccaggggaattttatcaaacgtttaaagaagaaaccatacctattctcctaaagctgtttggaaagatagaaagagatggagtacttccaaattcgttctatgaggccagcatcaccttaattccaaaaccagacaaagaccccaccaaaaaggagaattacagaccaatatccctgatgaacatggatgcaaaaattctcaacaagatactggccaataggatccaacagagtacattaagaaaattattcaccatgatcaagtaggatttatccctgggacacaaggctggttcaacacccataaaacaatcaatgtgatttatcatatcagcaagagaaaaatcaagaaccatatgatcctctcattggatgcagagaaagcatttgacaaaatacagcatccattcctgatcaaaactcttcagagtgtagggatagagggaacattcctcgacatcttaaaagccatctatgaaaagcccacagcaaatatcattctcaatggggaagcactgggagcctttcccctaagatcaggaacaagacagggatgtccactctcaccactgctgttcaacatagtactggaagtcctagcctcagcaatcagacaacaaaaagacattaaaggcattcaaattggcaaagaagaagtcaaactctccctcttcgccgatgacatgatactctacatagaaaacccaaaagtctccaccccaagattgctagaactcatacagcaattcggtagcgtggcaggatacaaaatcaatgcccagaagtcagtggcatttctatacactaacaatgagactgaagaaagagaaattaaggagtcaatcccatttacaattgcacccaaaagcataagatacctaggaataaacctaaccaaataggtaaaggatctataccctcaaaactatagaacacttctgaaagaaactgaggaagacacaaagagatggaaaaatattccatgctcatggattggcagaattaatattgtgaaaatgtcaatgttacccagggcaatatacacgtttaatgcaatccctatcaaaataccatggactttcttcagagagttagaacaaattattttaagatttgtgtggaatcagaaaagaccccgaatagccaggggaattttaaaaaagaaaaccatatgtgggggcatcacaatgccagatttcaggttgtactacaaagctgtggtcatcaagacagtgtggtactggcacaaaaacagacacatagatcagtggaacagaatagagaatccagaagtggaccctgaactttattggcaactaatattcgataaaggaggaaagactatccattggaagaaagacagtctcttcaataaatggtgctgggaaaattggacatccacatgcagaagaatgaaactagaccactctctttcaccatatacaaagataaactcaaaatggatgaaagatctaaatgtgagacaagattccatcaaaatcctagagaagaacacaggcaacaccctttttgaatcggccatagtaacttcttgcaagatacatccacgaaggcaaaagaaacaaaagcaaaaatgaactattgggacttcatcaagataagaagcttttgcacagcaaaggatacagtcaacaaaactcaaagacaacctacagaatgggagaagatatttgcaaatgacatatcagataaagggctagtttccaagatctataaagaacttattaaactcaacagcaaagaaacaaacaatccaatcatgaaatgggcaaaagacatgaacagaaatctcacagaggaagacatagacatggccaacatgcacatgagaaaatgctctgcatcacttgccatcagggaaatacaaatcaaaaccacaatgagataccacctcacaccagtgagaatggggaaaattaacaaggcaggaaacaacaaatgttggagaggatgtggagaaaagggaaccctcatacactgttggtgggaatgtgaactggtgcagccactctggaaaactgtgtggaggttcctcaaacagttaaaaatagacctgccctacgacccagcaattgcactgctggggatttaccccaaagatacagatgcagtgaaacgccgggacacctgcaccccgatgtttatagcagcaatggccacgatagccaaactgtggaaggagcctcggtgtccaacgaaagatgaatggataaagaagatgtggtttatgtatacaatggaatattactcagctattagaaatgacaaatactcaccatttgcttcaacgtggatggaactggagggtattatgctgagtgaagtaagccagtcggagaaggacaaacattatatgttctcgttcatttggggagtataaataatagcgaaagggaatataagggaaaggggaagaaatgtgtgggaaatatcagaaagggagacagaacataaagactgctacctctgggaaacgaactaggggtgttggaaggggaggagggctgggggtgggagtgaatgggtgacaggcactgggggttattctgtatgttagtaaattgaacaccaataaaaaataaataaataaataaataaataaataaataaataaacaaataaataaataaataaataaaaagaaaaaaataacaaagatactgtgtctggctcccactctcacagacattgcagtgcaatgagctccagagagacagttccagggcaagtgagagccagatggcactgggcagttctattcctcactgagacaataattaaacacgtgcagaggagatcctaagaaactgagaggataatgtcatcatacacattctttgtccaaacttgccaggaggagcacaagaagcacctagatacttcagtcaacttctcagagtttttaaagaagtgctcagagaagtggaagatcatgtctgctaaagagaaaggaaaatttgaagacatggcaaaggcagataagccccattatgaaagagaaattaaaacttatatctcctctaaaggagaaacaaaaaggaagttcaaggatcccaattcagtcaagaggcctccctcagcctttttcctgttcctgtttttttttctgagtatcactcaaatatcaaaggacatcctgatctattcattggtaatgatgcaaagaaactgtgagagatgtggaatagctctgctgcagatgacaagcagtcttataaaaggaactgctaagctgttaattgctaactgctaaggaaaaatactaaaaggatattgttgcatagcaagctaaaggaaagcctgatgcagcaaaaaaggaagtcatcaaggctgtataaagcaagaaaaagaaggaagaggatacagagtggcattcagttaacagaacaattatttaatataagttgcatcagagacaactgatgatggaaacgactatctcatatataattaatttgtgctgtgtaccaacaagaacctggcttgaatttccatgccaatttacaacccccatactgtaccagacaaggttagtgactactaaaatatcacaggacagagctctctaaagacacgtttggtagtgtgttaatggcaaaaagacactgtacagtttaaaaacatatcttacacagccttaaatttctaaataaatacaatttttaatataaaaaaactcacaaagatggtggattcacacttcataatttaaaatctcaccacagagccatagtaatcaaaacagagtggtattggcataaggataaacatatagagtaataaacaagaacagagtccaggagtaacctcttacatatatggcaaaataattttcaataaggttgcccagaccattcaatgtaaaaagaatagtctttttaacaaagggtgttgtgaatattcgacatccattagcaaaagaatgaagttggacctctaccatacaccattaaaaaattaaatcaaagtgtaccaaaaacctaaatttaagagttaaaaccatgaaactattgaaagaaaagaagataaaatcttcatgaacttggatttggcagtggtttcttcaatatcatatcaacagcacagggaacaaccctcgtcttccttgagaacaattacataaattagactattttaatacatcaaaagacacaatcaagagaatgaaaagacaacccacagaatgggttgcacagatgaaaaatctaattaaaatagtaatatgtcaaagccaataataaataaaaactgtaatacataaagaaaaattacagtttaattcactatattaacagaataaagcaaaaacaaaattgaaaacaaacaaataatacacaagtaacaaaaattatatgatcctagatcatgttgtttttttgacaataaatgacaaggaatgaaaataaaattataaaataaatgaaatgtgtccacaatagactttaaagtgcatgtttttggcaactttattcataatagcccaaacctagaaacatcccaaatgcccatcagcaggaaaataagtgggaaaattgtagcatattcatgcaatagaactcaactgaaaaatataaaaggaataaactattgacatatacaatagtttataccatatacatggtctcaacaacattatgttgagtgacagaaattaaatacagtagtgtattattacagtttataagttcttgaaaaggcaaaactaaaacgttggtgatagaaattagatctgaaaaaaaaaagaaattagatccgattgcctgggggaaaattgatattctatatcttgattggaatatggattatttgggtgtgtacatttgtcaacatatgtcaaagtttatacttgaaagctgggcttataaaaatatatgtctgcaaattatacctcaatcattacaaaaagaggtatttcaacaatttttagtatgagggaagtaaccccagacaatcctactagacgtttaagactattgaattgtaaggaagatacatttatcattttatgacattaatgtatgagttggaagagagagaagaaaattatttttcatcctttcattgtaaccatgccttcatatatccacaatgtcttcagtatcatatctttgaatattttgctcacaaatatggaacaaaagccctaaaattctctcctaggaatatcatgttttcaaaagaagaaaatcctattttactacaatattcctatagcagtaggaaatatggaaaatatgatggtccctctattttatgtgagatagaaatatagaaacagggagaaaaaggttgatttaagagaaaaaaaaaagcaaagcactgtcagtactgggggagcaaataatgaaaatgttttgctttctaggaggatatgataaccagtctccacaaggatccccaatgtctctcaacctccagtaattaactcttgtacagtcctctcccacattttatcagaattggcctagacatcactatgatcaactgaaacagcagaagtgatggtatatcaatcccaggaacaggctatggaagacattgcagctcccatccctttctttctctcatcacttgttcagctgcatgatgaggaactgagttctccagtcaacagccatatgaatgaattttcttgcaagtagatccaccagccccagtcaagccttcagatgactgcagctttagccaaaccttgactgcaacattatgcagactaagccaaactactcagctaaactgctccccactttctgacctaagaaataatatacatttattgctttaagccactgaattttggggtaattttttatacagtactaaatagctaattcactgggactctatcagaaaatgtggattacagttactcacttactaccatggcctcagaaatgcatgctgatttccagaattcatccagtttttctttaaatgtagcagtttttcactttatatgtcgtgtctttaaggttggttacattacatatttgaagatgcagaatagcctgccttgaccctcaaaattagtccctgtctcctctaagaatctggctgctgttctcaaaatgctgctcagcatggtattatcctagctcgaagtttaattgataattcatagacatttactctattatagagaactagtaatttccatgtgagattttgcatccacaaatgccagttacccttgttctacctgactgtccaaaagcataagtcaataatgggaataaagtgagaaggagaaactgaagacaccaacttcttatagaactattatgtatttctgctctgaaccttcttctatcctgggtctagatgccttgggtctaggcacagggtaattttgaatagcataatcatgtactttaccccatgtaaactggcaatcaaaagtatgggagaggttttaagtctcttgacaatacctgaaagaaaaagggaattttacccttttccttttaaggtctctatttagcccattgatggggagagaaaacttgcccaggggaaatgtccttaccagtgttattttccaaaaatgttcacccaaagcctaaagcagaacttatctatgctacttgcctcaatcttaggtagtaacaactggagccttaacttcttcgaactttctcacctgtccagatttatgaaaagaagctttattttctcctcttttccccagtctcatggaaagaccaggaataatcctaatacaggaagtccctattctatcctattattcttgaattagagtaattcatagcatctcttaactgcctcgggtggaatgagaaagcaggcagaggaaatagggttaggaaaagaactgcagacttcttttgtatcacaaccaccaaaagtataaaattaaggatgcctgggtggcttagcagatgagtgtctaccttcagctcagggtgtgatcccagagacccaggattgagtcccagatcaggctccctgcatggagccggcttctccatctgcctatgtctctgcccgtctctctctctctctctaatgaataaataaataaagtcttttttaaaaaatataaaagcaatcccaaattctgcttagtaaaaatacaaaaaaatctaaaactttttggttagccagcaaaccacgtacagattctcattgtccttggttatgtggcacagcacaataaagactggcatgaaaatccatttggctactcaactggtttgaaatattaaccctacttcttgatcagtaatactcaattccaacttcctgctaggtttacctgaagagcttctcaaaaagtatcattactaggattccacctcagactaatcaaatagaaatttcttggtagtggaggagaagaacagaaggtagagttatcaatcagtaatttaaatgatattctcaaatgattatacaatgcacccaggattaagacccacaagcctatgctgacatctccatgtctcctatttcttatctagtagctcatgctgagtcttcaaggcagagtgaggtggaagggagtacattgttcaaggactctctaatcacacccaccacaatgggcaaagacaggaaatacttgaactctgttattctcattaagagtttcacccacaatgcattgagtgttctttatcaatatcactatcttcatgagtgtaaagatactgaggtgcctcataaaacttgaatgtcactaaaaatcatacaggaaattacagtataactggccttggagtaaagctatggtagaatcctttggttctatcttgaaagtgttatttcattttctttatcttctaaatactctgatttcaaagaatatattaggcaagggtgatctttgaaatgaaattataagagtaagagcttgcttatgaagaaattgaaggtcattactctgtaattacaacaaataaaatttctagccatcttataaatgtagagaagccagagcacatttccttatgatgtggaaaacaaaggcaaaagaaatacagaaaaaattaaactgcattgtaacttagagccagcccattgacaagcacttaggacaggccaggtgatcttcctccaggagcccaactgccttcatgttaatacaatgccagagacaaaagaaaaccttagcttgacattagccggacctccaggatcctgtaaaattctctttggaaacttcctttatctctactctaccaagatatatgttagctaccatcccctaaacatatggcccactgatatgcatctgaagggtcgcatgactaaggttttactagacagtagtagatgaccctcaaggtcctggaaactttgcttccaaattccttagagacttaacactataccctaatcccctcccaacttgaaagtgtataatcaaccactcctcacaatcccagtgcagctctttctgcccatgggtcccattcctcatgctttaataaaaccactttttttttttgcaccaaaaacatgtcaagatttctttcttgactgttcactcctgaatcccaaattttacatcatttatatctgttatattaactagtctatttaatttttttttctgaattgcttgtagataaattagagaatcgtgagctctacctctcattctggcatgtaaatttataaattcatttggataatctgatcagaactctcattgattctgactttaaatattctgtaaagctcagtattttggagtatctaggtttccatttcaacttgtaatctttagaaaaatcttctcaacatctcagatctatgataaccatttaaatttcatctctacatccaaattgtgggattttaaaagttgtgatctgaaatataggttgctgaacattttagacatcctttttgtgtctgtctgtgagctcacagaagcatttctagaagaaggaggaggagaagaaagaatgaagaggaggagaaggaggaattctaactccagcacctaggctacttgtgtcttaggtaccattttaaaatctccaaaacaaatggcttgattttatccttagtgggttttccaaaattatgaatgcagcctctgttattatttaataagaggtaacttctggtgttttttattttgtttttaatagtccacaatgaatgcttgagtatgggaggggcagtgcatagatggtcatagataccctcaataaagaagactgcaatataggggatgtacatggcaatggccaaaaaaaaaatatttgtctgcactgcatcctgacatttgggattactagtgtcaggacagtttcatatcctgtgtttcaaacattctctctgtagtgggtagtgaacactggagctgaactagttagagtttgaagtctagatttaccattttccagtttatacattttaagtcttgctttcttcacctttaaaatgaacatgatatcaacttcacaaggtattgttgttgtgcccaagattgcgaatccgagaaaccactaaggagccgacaccgatgcaagtgcatgagggtttattagcaagctccagcttgggtccaagtatacctgacacagcggagcagggacatggacccccaggtgggttccagctgggtttttatgggctggtctaggggatttccagaaggagtggaggaatttcttaagctctgttttcattctgatatggggctttcaagggcgttctgtggtttttcctgtaactgaagtagggtaaagttcagctcttattcacaggggcctgagatggctgtacttgtgctaatgctgaacttgaggcggaatggccttaatttgctcggcctccacaattgtaagatctaataagatgttgtacatgaaatttagtataatgttaactgggcactatgaaaacactcaatatagtttgggttttgattattaattgtcagaggatactggtgttaaccagaaagccaggcccaagatggagtcacttgcccccaggagagcaaaccaagacttaattgcagtttcaacttgccaggagtagaattttaacccaatccatctagaattttctggtcagcaccaatgaggtgatttgtcacaagggccctccatctcccaaaggaagatgaggcaatccacctagtaagacccctttccttacctgtcagggaacatgatcacgcctgaaacagttccttcttttctcttgctactagcctcttcagcatattgcttcccttgatgtttaactatcacaaactactaagacatttttgtaagcagttgttggaaaatgcatataaatgccatttgtataatctgacaccaagaaagccctaggattaatttatggacaaattatgttgctcttatctttggttcctccctaactttattattaatgcaaaggttttcaattttatagctacgtatccttggttcatctgtgtagctcttttagagtaaatgaattaatgattaactttataaatcaaccaagacattctcaccaaaaaaaattattgcacagttcatcttttttttttcttttaaaccagccaaaatcttgttcaaaacagtacatattacatgattctagacagatatccaacaacacaaacaatatttcaggaatgaatgtaatttttacaaataaatctagatgttgagattatagttttgatatacaaaatcaagaggacagtggaatattttatacctgaaactaacataacactgtatattgactttattggaattaaaattaaaaaaaatagaaaggacagcgggatgcccttgcatatagtatatgaaatataaaattgacttcagagtgtagatttatatatcactggcagcatttgccataaacaatggcataggttgcctaaaaaaagcagaaggaaaaaaaaaatccttgttgtcaccaaagattattttccatgtattaagtattcaacaataataaataatagcaatatatatgttagagatttgtatttttaaaatgatgataaatctaatttatgaaaaaaaatgaattcagtatcttctctgacagaaaagaaatgccttccagaaatggcataataacagggccacacctccatctcttggctctgccatgcttcaaattaacttcaaattgaggtaggatccatctttacagttatccacagtattgccaagctcatatcttaaaagatttaagccaaataaaagatacagagctttccctcttggtaggttttgtaagtccagagattccctctaaatggatcaacttgggtagcatacttcttcccaaaacaattattgtggctgaagagatttgatatgtgaaccggctcagccttaatcacctatttaacccatagtccaggatttggagcctcactcaaaagtcatttacggaaaaataggaagacatcgtttctcaaaagaattttggggttctcaggcaaaaaaattgggagaggatggttggtgtgcaaatataacacatatttattttaagatataggagtagaaaataccaattatggaatgttagaaaaatctcaccctactttcttccacattggccatggtgtatatataaactttatttttttagtcaaaacattactctttgaaccctgttgaatccttttctttcttacatgttctcactggggactttgtttatcctttggggataggaaaacagacgggactccatgaaaaaaagactttttacctgcacccccatcttatacatgccttatggttcagataatatatgtcctcattacaaagatcaaggagttaatgatatttttggagtctttcagtacaatagataacatctaaggagtgactgggtggaatgtcatttacgttttccagaccactcaccgtgactcctggttcccagacataagcagcttattgaggacacctaaaccctaatctttgttttaagcagcttctggatgcctgagaagacaggttacaccagaccataacccttaataaaaacactggggccccaagcaaagatgagacttcttctgctttctaagtctctcaaacattctgcatctgctctatctctctatgtcttcaataaacttggctcccactttctttcagttcacatttgatttcaatcctgtgcaaagccaaggattcttttagttggttctgcaggaaccccctctgggcccttgtaatgcacttttgggatataggtggggtctggagccaacagccaagaaggaattcttgagatgtctttgatgcaaaaagatgattttactaaagcacagggacaagacagtgggcagatagagctgcactggggttgtgatgagcaactgattatatactatgaggttggggaagtaagaaaaaaaggaagtgtccaaaaagactttcatatgctaaagcagatcttaaggtactagaggccttacaactatcaagttaagtacattttttccctctagcaaagcattaacatcaagatagttggaagtttcctggaggaatgtcacatatatcccacccagtgtgggggaagtggaggaggttgcagggtgtcagctcgtgctttgtcttcaactagccttctgctctctcatcatttggagccagccagtttgcatcacttttgtcacagatggttgtatcacctcttttctctcttcctttttcctaggcaaataaagcatcttctagcactctgttttcaaatgcctaatttaagagttgttattaacagcaccaaacttgggatacctgcgtggctcagtcagttcaatatctggcttgattttggctcaggtcatctcagggtcatgagatcaagccatgaactgcactctgctctgagtgtggagtctgcttgagattttctccctccttccatctctgcctttccccctaatttctcttttctcaaataaataaataaatcttaaaaaaaaaaagtaccaaatttttccagcatcagttttcttccattatttcaggaatgtatactgattactgttgtgtatgtcttgcacatacacagagaatttactactaacagaagtcctgctttatactgttaaatataacagtaaataaatatattgttaaatataaataacaagattcaacaaggtaaatttgaagacctaattagctctattaaacaattcatgaatcaagcagctccgtctagcaagagatacttcaaggagttatataaaatgtcacgttttataggagagtatgagcaagaaatttattagtaaagaaaaggattgttccaggagaggccactttttaggggcaaaagcaaggggtcttattgtgtggattattattatggtgtaggctccaggcagccttttcaagtgtcagcagttgctatgtaattctaccaagtgcataaggcatagatgatacttgtcattgtaaaaggatacggctgaatgtattcaacttaagttgtgtattcaacttcaatttaaagaagttaaagaattatcatatttaatatatgaatcacctaggctctgtagttttatgagattccaatatttttcacacttaaaaaacaatgcttcaacatgtggctgtgagattggataactttaattcttgtttccattatggggatatttcttgcccaccaatgatttatgcccttaccaagggagaattctcaattcttgcaaaagaggtagcccttattcttcacccttagtcttctctttcctgtcatttccccagacagaaaactattagctctttctatgaagcatttccttcccatgcactccagtttcatgattttctcttctccactctttatagaagcatttttccctcttcatggtaacacatattttatttataaatgttaaatgacacatgtattttaaattactgtaggggcatctgggtggctcagtcagttgattgactcttgattttgtctcatgttatgatcccagggtcatgagatcaagcctgacagcaagctccaagctgagcatggagccttcttaagattctctttctctgggatacctgggtggctcagcagttgagcagctgcctttggttcaagggcatgatcctggagtgccggggttgagtcccacagaagcctgcttctccctctgcctgtgtctctgcctctgtgtgtctctcatgaataaataaataaaatcttaaaaaaaaaaaaagattctctctctcccgcccctcccccctacttatgtgctctttctcttttaaataaataaataaaaaaataattgcatactatatatccttacatgactatagtagttggctttttactagtattgctcaaaaggttaaaagacactagaaatgactctcttattgcttcttgatttgttttcagaagcttttttttatatactcagcctggtcttagacttacttgcagtatactccacaaacatgagagggcagcatctacagaaattgtattagctttaaaaagcattgctgggaattatatatatatatatatatatatatatatatatatatatatatatatatatatatatatatatatatttaagatttatatatatatttaagattgaactgagcacagagcccaacgcagggatccatttcagatgatgacccgagctgaaatcaagagttgagctctctctcttttttttttttaatttatttatgatagagtgagagagagagagaggcagagacataggcagagggagaagcaggctccacgcaccgggagcccgacgtgggatttgatcccgggtctccaggatcacgccctgggccaaaggcaggcgccaaaccgctgcgccaccccgggatccccaagacttgagctcttagtggcctgagacactctggtgcactgggaattatacattttatcagactattcactctttctcacttttctccacatattctccctaccacccactcaaatgtatttgtccagtccttttttaaaaaattaattaatttatcttttaataatctctacacccaacttggggcacaaactcatggccccaagatcgagtcccatgttcttttttgtttgtttgtttgtttatgatagacatagagagagagagaggcagagtcacaggcagagggggaggcaggctccatgccgggagcccgacgcgggactcgatcccaagactccaggaacgcgacctgggccaaaggcaggtgctaaaccgctgagccacccagggacccccgagtcccatgttctactgactgaaccaaccaggtgccctgtatttgtccaatcttaactcagttataccagttacactttagcttctatattgttaagggtattaatattgatatttgtacacacaagtcttttcccttttgctcattggttatctccaatctgagtaccgacagaaaacatttactttatgattctataaaagttgctttttttccaagttcaatatcataacttctaggtcaccagaaggagactattcctggtatcatactaaatgatgtatctgttcttacacttcagcaattgcttaagatcataccttatacttctttaaaatacctcaacttttctcaagttaccgtttctgccaaccttccacttctctctatattttttttgcaggataatttactctctgaatgctctgcacttaaatctttggagcatcagttgtcatttgtggttttccaccctctttgaacattctccttgcttgctataattttcccacattagaggctttcctctcaagtggaacgtagacaccggtgatacaggtgttttctctaaacagctcccatgatggctaggagttctattactgctcatgttcatgagaatctagctttataattaccaagtagtttgtgtgctatcctttaatacaacccttttcagctaacatttcccagaagtaaattctttcctttccagtttattgtggaggccgagaaaaattaaggccatcccacctaaagtttagcattagcacaagtacagccatcttaggcccctgtgaataacagctgaactttacaggaaaaactgcagaatgtcctcaatgtccttggcagggaatcccatgtcagaaagacaacagagcccagccagtggtagaaagtcccatattagaacatgtccttttatagataatcttttcatagagatttacttggtgaagatttctccttgtctcagtgtatatatattgttatgtatatataacattgcatatatatttcttttcactgttcccatttttaatcaattctttcttaatttataaataggttaatgaatttcaaaaattgtggattccactatgtgtgtatttatattaatttttacaatgactttttactgaagtatagttgacataacatatttgttttaggtgtacaacatagtgatttgacaattctacacattatgccatgcttaccacaataaggtagttgctgtcatcatatattattacaatattattaaccatattccctgtgctatacttctcatccctgtgatgattctattttgtaactggaagtttgtacctcttaatccccttcacctattttgtccattcccccacccaattttacaatggttttagatttatagaagagcccagagttagtgcaggtgttgccatgtactccatcctggtttaccctattagcattttaaacatttgtataaaatgatatacgttttatatatatttatatattatacatttttacatagtgctatactcacactaataaaccaatgttgatgcattattattaactgaagttcatgccttattcagatttccttagtttttacctaattctctttttctgttctagtattttatccagataccatattacattaatttgtcatgtcaacctaggccactcttggctatgacgatttctcataatttatttttaattactttgatggtttgaagagttctgacaaagtattttatagaatgtccttcaattagggtttgtcttcatttttcttaaatggttagacaagagttatgtgttttggggatgaagcccacactctattgagtgtagacagtcacatcatgtcaagggtacatgtggtcaacatgacaacacttttgacgttaatcttgatcacctggtcttaatctggagttatcaattagtgatagcagagaatgataggcagaataatggccccttaaagatatctacatccttattcccagaatctgtaagattatgttatattacatagtaaatagggattatcttaatagcagaaaaaaataaggttgtcaatcagctgactgtaggataggaagattatccaagattatctgaatgggcctattataataaagatctttaaaagtgaaaaaaggagatcaaacaaaggtcagagtgatgcagtaggagatgaattcaacctgccatttctggtttgaagatgaaggatagagaccatgagccagagaatatgagcagcctttagaaactggaaagggagggaaacagattctaccatagagcttccagaaggaaataatggaatcctcccaacaccttggttttagcccagtgagatctgccagacttcagaactttaatatgataatttgtgtagttttaagacactaaatttgcggtaatttgttagaacagcaataggagactattataaggatgtttaaaattcaaattgtaatagtcgatttatctatttctccatttcagttctattagtttttgcttcatgtactctgatattctgatgtaggtacatatacgtttaggattgttgttgtttttccagaagtttttaattagattctgttgtgcccaagattgcgaatccgagaaaccaccgaggagccgacaccgatgcaagcacacgagggtttattagcaagctggagcttgggtccaagtatacccgacacagcggagcaccgacttggacctcgaaatgggttccagctgggttttttataggctggtgtaggggattttcagaaggggtggaagaatttctccaagttctgtttacattctgatgtggggctttcaagggcattgagctctgttttcattctaatatgagactttctaccatgggcgtgggctctgttgtctttctgatatgggattacctgctgaggacattgaggacattctgcagtttttcccataaagttcagctcttattcacaggggcctaagatggctgtacttgtgctaatgctaaactttaggtgggatggccttaatttttctcggcctccacaattctagttagttaatatacaatgtaatattaatttcaggtgtagaatttagcaactcaacacttatatacaaggattgttatgtcttcttagggaattaactcctttatatgtattacacttcaactgaaattaatataaatacttcggctttcttacagttactgttagtatgatatatctttctctatccctttacttctaagtatctgagtctttataatttagagtgagtttcttattgacaatttagagctgggtcttgtcttttttatctatgctgacaatcacagtcatttaatcggtgtatttaaaccattcatgattaagatgattttttttatggagtcaaattaatatctactacctttgtaactgttttctattcgttgtattttttcttttttatctcccttctcccttttctaccttttctgttttcttatttttggttttctttttttcagtgcaaaatagtgattttattaaagcatggggacaggacctgggggtagaaagagctgctgcatgctgctgcccactgttccctgctgatgcccactgctccctgctcaccttttctagtctttttttctttttttttttttaagattttatttatttattcatgagagacagagagagagagagagagagagaggcagagacacagggagaagcaggctccacacagggagctcgacgtgggactcaatcccaggtctccaggatcatgccccgggccaaaggcaggcgctaacccagggatccctcaccttttctagtcttgacagatctttttatgtgattctatgttaccatctcctttagcatatcggttgtacttctgttaaaaacctttcagtgatttacctgaagtttgcaatatatacttttaaataacctaagctcacctcaaataaccttataccacttcatacataatgtgaatattttgtaatagagtattcccaaataatttttcttataccttttcttataccttatacctgtcattcatttgtccatatgctataaacacccaaaatactgctgttattattgcttcgaatggttaacctttatatctattaataataagaaaaaagaaagtttaattttattttcgctttttttctctgaccttctttccttttcttatgcagacctatttttctgatctatgtcatttttcttctgccttttcacatttcttgcaggccaggtacaccaacaacgaattcctttggtttttgtacataaatctttatttctccttcaccttattttttattgaggtggaatccacgtcacataaagcatatgattcagtggtatttattacattcacagtgctgtgcaacgatcacttctatctaattgtaaaacatttttatcactcctgaaggagacttcccacctatgaagctgtcacttttcattacttcctttcctcaaccctcagaaaccacttatctgtttcttgtctgtatggcttgacctattccagatattttatataaatttcattgtaccacatgtgacctggctttttttactcagcacactgtttttgctgggcatataattcattccactcccctgatggattccaattcactctctaccttttcttgcttacatggtttctgacaagaagttgactgcaattctaatcttcatccctccatgggcaatatgtttttctcccgtaacttcctttgagattttccatttgtctttggtttcatgcagtttgaatataatgtgcttaggtgtaatacttttagtgtttatccttttttggtattctctgagcttctgggatctgtgcttccatatctgtcaaatagtttaggatgttctcagccattatcatttcaaatatttcttctgctttctctcttcttctggtattccaattgcacagatgttacatctttagatagtgtcccatagtttttgaatgtttatagtttgttctctttttgtcattctttctttttttttaacattttagtttgggaaatttctgttcatctcttttcagggtcactaactctctcttgaccattttgagttcacagacaaaaaaaaaatgctgtcaaatttctgtgtctgcttatgtggcttatctggtcttgcatgtttccttttttatttctagtggagaccttttcatatcattcataatcattttaaatttcctgcctgataactacaacttctgtgtcatatctgagtttcattctgatgctgaatttgcttcttcaattgttttctgtctgtgtgtgttgttttgtttttgcctttggcatgccttgtaattttttgctgaaagtcatacatgttggatgaggtaatagaaactaaagcaattaggcctttaatagaaggatttatgtaaatccaattaagagttgggctatatttaatgttttccacagcataggcactaaaggctttaacttcctctactgtctttgtttttgtcctccacttggcattggggtttcactatgtactgttttttaaagtttaattctaatttccttttttattgcttgtttgacccaaggtttatagaagcatgttctttagtttccatatatgtggggatttttgctgttatcttcctgggttgctttctaacttaagtttactgtgaacagagaagatacttcttataatgtatcttataatgaatcttttttaatttattgagatatagtttgtggctcagaagatggtcgctctttgtaaatattctgcatgaacttgaatagaatgtgctttcttaaggggaaaggagagaaaatgagtgggaaatatcagtgagggtgacagaacatgagactcctaactctgggaaatgaacaaggggtagtggaaagggaggtgggcggggggttggggtgactgggtgatgggcactgagggtggcacttgatggactaagcactgggtgttatgctatatactggcaaatcgaactccaataaaaaaaatatacgaaaaaaaaagaacgtgctttcttttgctcaatggtatgtcctatatatgtgactttgtttcacctaattttatcagatttttatttatgaattctgaaggtctgttagataatattaagcatttatcatttatgtttattgtaaatgattattgttatataaacatttagtattataacgttcttatgatgaatgatccctttattgttatagaatgaccttctctatcctggataatattctttctttgttctataatctactgtgatgctaatagagccatttcagctatcttttcattaatgtttgtataatatgtctttttccatccttttaattttaacctatttgtatttttgcatttaaagtatttttcttgtgggcagcatatatttggctatttattttcttaaccaatccaacaatctgcctttgcatttaatgtcattattgatatagttcaagtctatcatctgtttattttctgtttgttctatctatactatcttaactttttcctctttttctgttttaatttattgattatttttgatgatccattttcttgccttttctggcctattagctgtaattttattgttattttagtggttgttcacagtttatggcattcacatttaacttaaaacattttaagcttgactgctgttacattatttcatgtctagtaggagactcacagcagtatattttcatgttttcttcctggactttgtgctattgttgtcatacattacatttttttcttctgttataaattccattcttcattgttactatttttgtttaaaaagtctcttatcttttaaatttttgaaacaataaaaagatatccttctataattacccatacagatatctgttcccagtgctcttcactcctttgtatagatacaaatttccattagttaccattttctttctgcctaaagggactgtcttaaacagtttcattcatttcatttcattcatttcatttcatttcatttcatttcatttcatttcatttcatttcatttcttgtagtgtaggtctactggtgatgacaaggttttttttctgcttgtctataaataaaaacattttttaaaagattttatttatttattcatgaaagacacaaaagagaggcagagacagagggaatagcaggttcccagcagggagcctgatgcaggacttgatcccaggactccagcatcatgccctgggttgaagcaggtgctcaaccgctgagccacccaggtgtcccaaatgaaagcatctttatttcacctttgcttatgaaaaatgttcactatgtattaaattctattctgataatatatgtttattccagtactttatgatattcctccacagttttctcagtttcactgcttacaatgaaaaatattctgtcgggatccctgggtggcgcagcggtttggcgcctgcctttggcccagggcgcgatcctggagacccgggatcgaatcccacgtcgggctcccggtgcatggagcctgcttctccctctgcctatgtctctgcctctctctctctctctctctctctctctctgtgtgactatcataaataaataaaaaaaaaaaaattaaaaaaaaaaaaagaaaaaaaaaaaaagaaaaatattctgtcatctttacttttgttcttctatacataatttaattttttttactctggtttctttaaatctctgggctattattttaaaaatttacttatttattcatgaaagacacacagagagagaggcagagacacaggcagagggagaagcaggctcctcgcagggagcccgatgcagcactcgatcctggatcctgggatcatgcccttagccacccaggtgtccctaaatctctggttttaagtaatttgattttcatgtgctatgtgttttctttacattgtgctttgagttcattgaattttgctacagagtgaatgtttgtgtgttcccaaaatacatatgttgaagcctaatccccaaagtgatggtatttggtatgtccacatttgggaagtaattaagagataacaatggagcccttagaaatggaactagtgtccttgtaaaggagaccccacagaactccatcaacccttcagccatgtgaagacacagtgaaaagacagccatctacaaaccaggaaacgagctctcactggacaccaaatctgaagacaacttctcagcctccagaatcatgagaaataaatttctgtagtttatataccactgagtatatggtatttttgttagaggagcccaaacagactaagacagttttttgggtctggagtttataatgatcaaatttagaatatatttttggttcttattttctcaaatcttttttctgtccactctcttcttcttttcaaggacttcggctgcctttgtattgggccctttgaagttttcccatgactattgataggctttgtttttttcaattctttttttttgcgtgtgtgttttatagtttttgtttctatgttttatagtttctatgttttatagtttttgtttctatgtcttccaaattcactgatcacttatttctgcaatggttaatttactgctagccatattcaatataattttcatctcacacattgtcatttccatctaaagaagttaaatttgttttttttaatggatatctctagtgaattttttgagtatctgaaatatagttataacttttattttcatgtcattgtttcttaaatctaacacctgtatcagttctgtgtcaatttcaatttatcgatttttctgttcaatttgagttgggttttcctgcttcttttcaaatctgttaattttttattggatgtcagacactgtgaattttatcatgttgagctctgctctggaatgaagttagatacttgtaaataaattgatccttttgagtcttgcttttaagatttgttcatccgtattggatattggatcagtttttagtgtagtgctaattattctctgctactagggcaagatttttctgggtattctaccctatatccacaaatttaccaggtttttcagtctagctcatgaaagtacattctcttcttacccctgtttaaaccttaagtactatttcctctaatcatcttattagagggggaaaaagagcctttccttacttctactggtgaatatacttagaattccccaaagtagtaatttcccttattaatatctttggcaaagcaataaaatgtctttctttaaatacttcaatttattctctcctctttggttttcctagacctctaccatgttgacgtcatcatatttgttagaactggtttgtgcttagatatttgtctttttctttcctcaaattatccttgtatttaagatatagcttagcatgtatcaaattataacttttctccaacatttgaaaatagcactattttgtcgcttttatttagcattgctatggagaaatgggaggaggtttttctaatttttactcctttgaatactgctttaacagtgctactcaaagtgttgttcacagaccagtgagctatattaactatttcttaccagttctttatgagacaaatacagaaatagaatattacagatgttttagaacaaatcaacagagaaattttaaatatattgaatctaacaataaactaattacaacttgtaattgtatgcatgttttttattaacttcatatttctagtaatttattttagaaaattatcagtctttggggatccctgggtggctccgcggtttagcgcctgccttcagcccaggacgtgatcctggggtcactggatcaagtcccacattgggctccctgcgtggagcctgcttctccctctgcctgtgtctctgcccctctctgtgtctctcatgaataaataaaatcttaaaaaaaaaaaagaaaattatcagtctgtgatatattaaatataaagcaagaaagagcacttataacaatagcaactacagcataaaaattcttctctgcaattaagaaatactgcttaatatagtcaggaactgtgttcctgaggacttatggagcctcaacccgagaggcctcataatcagtgaggctgaggtcacggattagaactggcatgctagggtttacagagaatgggctattgtcttcacagtatagattcttcctgtaagtcacttaatattgcagagatgggaatgctccatgcatttaagattgaagtaaggatagactgacccagagaagtttgtctgggtgaaggaaaagatgtgggtgccctcagtcatgtcatagaaagaaatgtcattgtcttcataatccaaaaaaatcacaatcttttgtggacactttcctatctggagacagtcatcctgggaaatgtttggggggcaacaggtgagagtccggtattcacttcctttcttctctaagactctgaatttcttgttttgtagatctgtggatagctcactcttgtctgtgagtttctcataaacaccgagagtccactcatcaatgtctttaatatttacttcccagtagtgttttcctgaagtgaagtcttcctgattaagtatgataaggttgcagtctccttgcttatcactaagagacagatcctgtgtttccactctaaagttctcatttctctctgagtcagaattattctgatgaaagatttccatgttcacagtcacattggctgggaagaaagaaaagggaaaggaagggtcaatattatatattatataatatatatgttatatatatatatttcagaaagctgttgtgctggtgaaaccttaaagaaattaatcaagtagtgaaagaacccctgtcctctgaatgtgtgtgtactgggaaaggtggagctgtggagtgctctcaccatgggttcaatgctacttagctcattttatcttacctatgctattatcagtgtcttggcagagtatcagagtgagttgggacttgcagtgtttacttgagaatagtgttcttcccaacttctctacaaattccaactatgttcttcaattagtaataggctccatgtcagctggcctcttttaaaagagcagctgtgttactcatcattttgagcactttttacacagttggagatctcctcaactgaggggctataatttctgttcagaaccaagtgccccgaccaccacaggtgaaaaagcatggccaatatgtgaaagtggaaatataaccagagtagctaatcctagcagcaattttcagttgaggccaacaaataatgatcttcatgttctttcctttctttgcctctgtctttttaactaggagataatgttgagagggaaaaatggaataacagaaggcaggttagaaaggggtcaaaaggataaaaaaaaaaaaaaaaaaaaagagctactcaccacactggaagtgtttcttcctccagtctgaaaaagagcaatacaaattgaacctgtgatggaagcatgcccacagaatgaaaaggagggacacacttcctttcctatctcttctcagctctcttttcctcctcctttgagccctttgaactctgcagtgtccagaaactacaagacaaagggtgtacttcctgcatgtgtctcaattagaaatgatcccctcattgggcggatgctggaggagtaagtctggagaacatctagaacagggtctagtgttctaggcacctatgcttttaatacttttgtggcactcctcattgaggatgaaagctatacgatgtcctttcattttattttattattttattttatttcagggttttcccagccagtgaccacctcagagagtagagtttaagcttataaccagggcttttaaatgttccttttttattttaatgcttgtaatcatgtttttaatatttttctccagaaatttcttcatgaggaatagaagtacatctgcttctgcctggacccacttctcttatgacagaacttgtgactttatttaaagactggatattctcttagtgtcttggggcaataggcagtaagaatttatccatagggatgtctgggtggctcagtggttgagtgtctgcctttggctcagggcgtgattctagaattctagaatggagtcccacatcgggctccctgtaggaagcctacttctccctctgcctatgtctctgcctctctctgggtctcttataaataaataaataaataaataaataaataaataaataaataaaacttaaaaaaaagaatttatccataattcttgatggtctttcactgagatgcttcttcaaagaagggtagccctctatacatagaattgatgaatatataaggaggctgagatcaggaaagcaaaaaatgattaaattcttcagctgtgatggagctaaaactaaaatctgtatgtcctcatccttactatactttgttctctcctctagaatcatgggaacatttttaaacaccttctgaaagaaaactattagtagaaattgcatactgactttaacccttgggaggggcaccttgacctattttatcaaagtacttatcacactgtgagcagttggctggttcttaccttacttcttccaatggatcttaatttctacacagtcagagattatggtttatgccatcaacatctagaacaatagtgagcttataaaaatttcacaactatatatttaaggaaagacctagtatgcttttgaggtctaactctgtattgcacatgcacacacactgtcttaaacacacacagtacatggaccagagattagaatatataaaatagccaattccctctatcatcagacaaatatatcttcacaatggtagtaaaatatttagaaagattgtttttcaaactttttcaaatataaaccttgttcctgtatattgaactttcctttccttatttcaaataggtaaaataaataaaataataattaatatattttcccaaatagaaaatataatatattatctgctttttaaaactttattgagagtatagcaatgctgatataatatagagtattctttagtcttcttaaatctcatcaaaatcactctgagttcattcttcccttctccatagtggatgggttaacaattgatgttgagtcatactcaataatatagaatttataagtcaacagttatttctcctttaaccatagctgtaaaaaacaactgaatatatgagcttccaaatacaaaatactatagattgataccaaataaatctttacaacttgcaagtagatgtgtgtatgtgtgcttatatctctacttattgcactcagaatatcagagacacatagcaagatctaagttacttaccaggatacagcagggccttcttccaatctaaaacataacaaatccagttcagacaaggcaagacatccagagcctcacattctcctccctcccccttattttttttcactagtcactcttaaatctttcagtctttccctttgaggagagggagctaagaaagtgttagacatcaaaactttgaatggtgaggaaaacccagtctcttaccttcaaggtatagtgcctttcgctgttctgaaagaaagaacattcagtgagtcctagaacagatgtagaaaggggagaaaattctacacagggcatgagaggaagtaagactcaccaagctctgccttgagtttctctgaaagaagagataaaaaatccatcaaattgggttttggcttctcttgagttcatggagtagctgaatgaattcaatgtggcccttcctcagaggtcccatagttaagtaggtaagaacaattagcaaacacacattcagaatctaaaatgacaagtgctaggaaaagttacatgggaaacgtcataagttcattgaggaaggagtgcccatgcttcaatgggaatttaagatttcttaggtgtttaagaagcttattcttgaaggaagaataggaggagaagacaggggaagacatttctacaaggagacataacagcacagtttgggtacagacgcatgaaggccatggtgtggtttgaagagccccaccttagaggactgatagccactgcccacaactatccaagcttctcacatggtttcctccttttcatagggctccagctttatggaatttgaatttatgaaacaagggtattccatgtttcccttagggtcctttggcaaccttttatttcctcgcctgccttatacaacctgtacccccagcttttccatgaaccctatttgctctgcttccttgatttacctgtggccttctgtgccatttccttttcatttttcatctgatctctttcattaagttctctcttctttttctttacttccttttctttggcttgatgttctctccagccagtgtagctgattccaatgaggaggagcatcagcacagggactgtcccagccagagctgctttccatgggtccatcttggggaagaaaggctctgacacaggcatgtgaagacacagtgaggactagcctggagaccatcctgccctttccccaaagcttcctgagccctctttccctcttccctgccctcatcacactcccaactctgctttggggtttgtgcctcattcacctgggaggaagatgcatgatactttctcttgtccggagaggggattctggatggaacaggtcacattgcccagagagctgtccatgaccacaagagatgcttccacatggaagagcccatcttcatcttgggtctgagactcagagagggactgtagattcactcccaacatgtcattccactgtaccttgggttttggaaaccagccatctgaagagcatagcactcggatcccaccatcctcaggtcccatcatgtgaacatgaggcacagagcccaaccctgaggagataaggcatgtgtttaaggcctgtggtccttggggcttaggagtccctgaggctgaaggttgaagtgccctcactatactgataagtaaactgaagctcagaggtcaataaacctctcacagtaaatgttaggacaacctgtgattcaattttgaaatcttgaaaagttgatgtctttgcactaagactaagagagcttggggtcatttcaaggagaggaaaaaaacaggtacaattaaagttagaaaaagaagcttaattctataaattgtttttctctactgattgggtgaaaactaatgtctgagggtgtcagtacctgtctgaattaatactagtcaattaattttctggggtcttttaggataccaaaacatattcagaaatattgccttatttggtgtttaaagtgaatagaatatatagtcttatcctcactgcacagcttagaaaattggtattctgcaaggtaaattaatgtaagaatataaggatgatcataagaaatgccaaggtaggaatccagacatcctcatttttctttttgctttataccttgatatacatattctatgccaagttaacatacctatgacatgcagctccacaatagcctcttgggagctctgaccatccttaaaatgacactggtactggccatgatcagaggcacgaacatgttggatcagcagggccacacctcctctgttgatggagtccctcaccaactctgtcctgccatggtactccagcatttgctccccaccttgttcctgtccattctggtacacaaacacagctggagagaattgggttcggtaccaccgaatgtgcatgtcagctgcactctgctctggggacagctggcagggcagagtggcatttgcccctagcagaaccatgatgggctcaacgggtcccttcacagaaaacccagacactgcatgaaaatcaaagacagattggggaaatgagtgagggggataagacaaaaacacccatcttaatttctttcttatttgcattgtttcccaaaaaagttatatatatatatcctaactttatatatatatatatatatatatatatatatatatatatatatatatatataacctaacttctttaactatattctccagaagtaacaactactgatagtttggcatttgaaaggacaatttttccatgcatttacagatagtatttgtatgtaaattatgtaaaacctatatgaaagagatttacttagaattaaatgtggcaaagtagttcattaagcaattatcccttcttttggtaggagaggagtagaaggtacttctctccacacccatctctttctctcccaagagaaatgctgcaagctgaaaatgaagactttgcttaattatggaataagctcctttgtcaagtcacttaaggcatctgcttgaaaattactttatttaaaaaaaaaagatttttatttacttatttgagagagagaacacaagtagggtggagggtcagagggagagggagaagaagactccctctctgaacagggaacctgatgatgtggggctccatcccagaaccctggaataatgacctgagccaaaggcagacactcaatggacggagactcccagctgcccctgaaaattactttagtacagaaatcaatcataactaaaaggtgactgatgtcccctgggcaaaacttgtactggcaaaggccaaagatgtggcttttttctatggttaaagcttaaaggcccacaaatatggtgactctggagtgggaagaattcagaaaggcatggctatgaggggacccaggagtgttggaccaatggcaaggccacatgagctcaaaggaaaaatcccatggtcaatctgtcttagagagggtggactaggctaggcaaggagcatgacattggccatcaggctggatgaaggccatggtctcccttctctcccattcctgtgtaaaacccagagtactcaacagatatgtgttcttagttaacacagagctactggctgtacatgttgtatgagtcatttaatttagggaaagatatttgacattactcatagccacaatgtagtgtaaaagttattttatttctcttaaatggaatcattacataccagtttctgtaataaggaacatctaatcattttagtacagataggttagctctacctattgtttttgacacagcatatagcatcatgtttaagcttttcctgtatcagtgtaaatatttatgttgcttccaatttattattactataaacagtcccacaataaacatttaatacatatgtacatatacacatgggagaacctttttttttttaagattttatttatttattcatgagagacacagagagagagagagagacagagacagagacagaggtggagggagaagcaggctccatgcagggagccggacgtgggactcaatcctgagtctccaggatcacgccctggactgaaggcggcgctaaacctctgagccacctgggctgctccaaggagaaccttttatttaaaaaaaaattttttttattatttatgatagtcacagagagagagagagagagagagaggcagagacacaggcagagggagaagcaggctccatgcaccgggagcccgacgtgggattcgatcccaggtcagggatccccaaggagaaccttttttatgataaattgttgtagaattactgagtcaacatgtatggatatcaaacattttaatactccctgctaactgacatcagattaaagagattttaattaaaaaatctcattactgtaatctcatggttgatttctctccaaactagagtctgaaaactttatcctgagggtcctttctattttatgaaagaaggactcaaatcccagaggaaaacaaaaattatttttcaaagatcataaccagatagagcccagggtttccaaattctttgtgctcagacttgggttttcctcgcagtggggaatgttataaagtatatttaactgataatattacattgaaattaagcaggtttaaattacccgaaatcaataaataaagatttaaataaacattatagctatgagttttataagatctacccagagtaataaggggtgttgatataaagaccactcccattcttacccagaaccttccagtcttcggttagcactaacacagtcacagttttctccaatataagggccttggagaggaggtacatgacaactgatacatgatctaagttttgtcatcatctaagaagaaccagtaaaaacaagccaataaaaaaaaaggagagagaacactcacctgctgagtaccatgtagacacctcaagaaggaggagagggaggaggaagccagcaggagaacaaccaggagaacccaccatcttcttcagagcagaaagtgaaaggacaaaatgtttactctgacaaggaagtactgtgtaagacaaggtggtgagaaaaccacaagagtgaaaactttcaagaaaaaaaaaaatcccctgttcaaaaatttacttttatacacagttttggcctgttcttcacagaccactaccaacttcaacctctcccaatgcattttcctttcttctttctgaaaaccaactatttccccaacagatatagaaaactataaaccattctcttgtgacccacgggctctcttgaaattgaaaagctcgagttcattttgagaaataaaggcagacacaaaattaatccactcctattagccaatctaacttcctctttcttgcattcattcattgattcattcatacattcacatatttattttgaccacaaacactcttgtggcttaactccagaaagagaagggagttttcttaccatgtgaccaggatcccaagcctttttgtttttacggccttcatctccctcagacacatctccacatcaccacacatttctctcaccattcagattgagccaagagacttcctggaagtttctgatctcctcagactacaaggtccagctccagacacaattggtacctggttgctcttgtggtcagcatccaaagatatggctggaagggttgggaatagtaggtttctaacccattcttagactggaaaaatatccttaggaagggggttacaggcactgacatgtgaatgcctctcctagaatggatccagtgaaaaagtcacaacctgtctgcagttcttgcagctactttgaaagtggaggtaagaaaggtcatcctaggggactttggactggtggggctatagaacaatagtgtgccttggttaaaaaaaaaaaagctcagtgtagcttcctcctcctacctgcaaagggctgaaatcacattattcaggaagagagaatcctcttcctgtgtgatattcaaggatgttggtcatcccaatgttgaactcacaaagttaaccgattgagggaacaagagtaagagatataggcttcttcctaccataccctaactggcactgaaagctgtgcagggaaaaataagagttggaaaataaaggactttgtgctctgtaaagcttagggctgtatttccaaatctttagggctccccaaagtaaaatgggaataataacacggttatatgatcttagacatagaatgtgctcaaaaggcatttcttactacttcaattctttccacatccaagtcatgttttttcatgtcacacaaggcttacagataattaaggacacaaatagctgttgcatagatattagtatgaaagccactaacagaaagatgaatggataaagaagatgtggtctatgtatacaatggaatattactcagccattagaaacgacaaatacccaccatttgcttcaacgtggatggaactggagggtattatgctgagtgaaataagtcagtcggagaaggacaaacattatatggtctcattcatttggtgaatataaaaaatagtgaaagagaataaaggggaaaggagaaaaaatgagtgggaaatataagaaagggagacagaacatgagagactcctaactgggaaatgaacaaggggttgtggaaagggaggtgggcaggggtgggggtgactgggtgatgggcactgaggggggcacttgatgggatgagcactgggtgttatgctatatgttggcaaattgaattccaatttaaaaacatatgtaaaaaaaaaggaaaagaaaaaaaataaaaagaaaaattcaaaaaaaaaaaaaaaaaaaaagaaagaaagaaagccactagcaatctggccaaaggaataccaagatcttaaataaatattctctagaaacagtgaggtacatctgaccttttagaaatcaaatttatggagatataatttgcatacagtggaatgcatggttatgaaatgtacatttcaatgaagtttacaaatgtttacactcatgtaactaccacttccctcaaaatatggaacatatccgggcatctgggtggttcagtggctgagcgtctgcttttggctcaggttatgatcctgaggtcctgggatcctgtcccacttcaggctccctacagggggcctgcttctccctctgcctgtgtctctgcctctctctctgtgtctcccatgaataaataactaaaaacttaaatatatatatatggaatatgtctgtctcttgcaaatttccctcatctcctttgtctgtcaattcattccaggaaaaacaaacagtactctgatataaatcatgatagtttaaccttgcctattctaaaacttcaaaaaacaacaacaaaaaagaaattatacagtatgtctacttctatgtttggcttttttggaaaaacaatgttttttgagattcaaccatgttatgtttatcaatacatgtaaaagtttttttattgctgtataatatggcattttttgactatagaacaatatattcttctgcagttgttttcacatactcacgccctcctggcccaatcagccctccccactgaggcctctgtttcacttggcctctgacatccactttaggtctgaagtatttgggaatgggaagagaacactgaatgagaaatataaggattaaagttactacttgcttcttgtttactttgaaatttgtgaatatgcatgtgggtatattctattccaaaatgtaaatagtttaatatgcatttccagtaaagctagaaatataaatgtgaaaaattcatataaaaatcttagatagttttccaaatgatagagaattatttgaggaaagtccgttaatttgtggagaatactttaatggaattacatcatgtctataagaatgctcacacgtttaaggaggatgaggagaggaagggaaaaagcactacaagatattattgatttcaaaaagcagtttgattaaaaaaaattttttgtttcaatattactctttattgtttttttccctctctagatcccagcccaggatcacatgtttcatctagtcattattgtctctcttgatacaggaacggatttctaagttttagttgtcattagtggcattgacaattttgaagaataaagggcagctactttcagaatattcatcactttggatttgtctgatactgtcaaaaagcagttttaaaatggcatgaacagtataatcttatttgtgtaagaaatacggaaggatagacatcaaaatcacaaaaaaatgatatggtgtgatatgacttttttctgagtgatatgatgtttctgttgtttttgcttatgtcaaaaatttagatttttctcatgaaaaagtaaagactaatatgtatatgaagattttttaaaatacaaatgtaaaacacaataggaaggattcatttgcagaaaatgcaggactaaagaaataatttgtattcttgggagtggataactgacttaaaatagaaaccaactagcacagtcagatattagagtagacacatctaaaggtcaaaatattggggtaagagcactgagtgttgcatgaaagtgttgaatcactaaatcatacacctgaaactcatattacattacatgttaactaagtgggatttaaattaaaacttaaaaaatatatatttttggggctagaaaaatggagttactggattcttcaagaatatgatactttaaatcaaaaagataatatctaagaagcataagttcaaataagcacatcagatccagaacttcaacattcatctaataggtaggttttctaaactgggaagcatattaggagcagaatcagaagaaagggcactttataaagagttcaattattggaagaaaaaaatgcaatttatatgtgaatttttttaaagttttagaactacaaacaaacaaaagcctcaaagcttctacagtccgaaatacctgttatgtacaaaagaaaaaagaatcagcttccgttgtacatttgtcacgttgaattctttgctagaaaacaaatgtagtctttacatttcctagtagaaattagaatgatctaagcaacaaaatgaacatctaaatgtaggggcataggaaagaagtttttgaacaggcaaagaattagaagtttctgcctcaaaacttttcgtatctaaagagtaagtgttgcaggttttgaatgcagggcttggagcagggagaaggttttggagctacatcccaaattccatttattccactttgggtggccactgttatttgagttggagtaaggtggaaggatagatttggtagatattgtctaccaaaattagttacctaggaatggagaaggcacatgctgactatatctgttttcctttttctggcagcctttctcaatagagtagatccctccaagggagattatgtggcttttcttgtggtagtgatttacttcatgaatttaaattcaagtatcattcatatgcatgtcaaatccctgactgtttagaaaatgtgaatccaaatctctattgagattaaatacttaagcaagttgcaaaaagaatcctcgaaataagaagataattttggtatttatttataaaagaacacctgggaaagatctggcactcccaacacagtgtaggaaggggttaggtaagtgtcacactgggtcatttctactaatccatcttaattgcctgcagtggatgtatattaataaaaaattaagagaaattattggatctcataaagtcataaagatttggcatagcatagtttatataatttaaaacttctataacttcatttatatgttctataatgattctgttcatttctgactatgactataactttcttttggagttcccaactgattttgcattattcaatccatctgtatgtcattagcaccacttgaaagtccatgttgttaataaatgtatctatttgaaacggcaattctgtttctttgaattatttctctctgaatgttacttttattttaaaattaatagtaccatatctacaattgtatagaatatgtctggtttgtatttgtttacttcttgttttgctatgtctcttataaaccatatatagatattcaatcttagattcagaatttcaaaaatgtagattagaatttttaaaattttttcagtctctaactcagaatttctttcggtcattctaagcaagaaacaattattctagaattcatagaatttgaaggctctttgaaacaaaaataatttacgtagataggggacagtaatctcatccttactccttccattatttgcagcaccgaaggaagatgagagtctcagagaatcatttggggaattttatactgtttttcttttatcctggttgagatggataaaagccagatgtcagtggagaaaatttctgtctgggagaagagtcagagagtgtgaatgtgcccatgtcttctcagttcattgcctaatggaataaggggtccaactgggagatgaaaactcatcatcagaatggcagcatattgtggtaaggaagacattaaaataaaaaattgctaatgacctacacataatttataagttattgatactcttctaagtgctttaaatacattcatatgctcttcacccaaaacttagggtagatactattattcaacccattctcacatgaggaaactgaggctcagagaggttgtgtataactcactcaaaatcttaagttgtaaatagccttaccagcattttaactctggtagtcaagttctatatctatgctattaatctagacaatatacttctcagaaagaaagaaatcacttgcttttgatcctctctatactttgttaagtatgtaatcattaaatagacttattatacatgacaggtcaaagtttgctttctttaacttattttactttcagttttgagtgtgtcagggtggccaaagagaagtgtactgctgggagattcccatgccggggggtgtctttctctcagttgtttgaactaccttaaaaaaactaccccaggcttcctcctgggctccatgttttgtaaagtctgatatcctgtgggcattttggagaaagtctcacgggagacacctatgggcagccaagaacaggtaagtgggaggaatggcagagagtatttatccctggtgcctgtggccatgagtctaggaagtttcaggatgccttcatctctgtaagaagaatttaaaagatgtgagtgttgcattttatgggtgatgggcaagagagagagaagtgagagcatttgggcaaggatcctagaggttggcagagaacaggccacgttatatatgctcacattctatcaaataggaatgtgggaagagtagaattcatcgaggccaaattaatgtttgtgctaaagtcagctctttctgtgattgttcactgcctcttcactgtctctttgtctctttatcccctggacaaagtgttcttgagttggaaaaagagttcagagaaattgtggacagatttatcactgtagaacatggctgttgagatgaagactgtttccttgaaaaagggaaacaaaaggtatttttttgtgactgttaaaacttctgtaatattccctgggagagacacacaacagatgtttgagagcttctggaagccatttcctagaatcactgaactgccttaactgtgattgtttttactttatgaatcccatttttgtcttcagtccagctattttcagaccttactctgtgtcatactgttgtctactctgggaaagatggtgaattccctggactcctctctgctaagagatttcttctctatcctacttctccaggtatccatgtggggctccggtaagaatatttagtattttatattattatattctcttattcttaaaccgaatgattaaattactccagcactactcatatatgcctaggttaattctaaatcctttattttggtataatgatttatctgcccacacacgagggcaaataagtcattatatggttactttagagagaaggagcaggtggaattatttcactaatttcttctaattcactcaggtctctgcttcatggagaatgcattttctgatgcccaagacctaattaaaaactcaggtttcatgatttcccagcattattccctcctccttcatagaatttatcaccattgcaattttaaaaatcatttgtctaacaagaggctaccctattgactgggtggagatcctttttgtcttgttcactgccatcttcagcctgaatgtgtgctgcagagaagtggtgaatgaatggcagactgtctacggggttctactgggccagtaatgctgctgtgttccaaaatgcctgggcagttcattgatattcttttcactgtggctctattctacagattcattcttggttatcggcccctccgagccaattgtggccatgctgggcactgacacggtgctgccctgtcgtgtgtccccagccctgaatttggagagcatggagctgaggtggttccgctcccagttctccgaggctgtgtatgtgtataggaatggaatggagcaggctggagaacagctggtagatttcaaggggagagcagagctggtgaaagattacatcactgaaggaagagtagctgtgagaatctacagtctccggatctcagacaatggaatgtacaagtgtttttttaaaaaagacagtgactttgaagtagccactttggagctgaaggtgattggtgagtaattaccagagaatactgatcactctacaggaatgtaagtgttctgcatttgatttcaggggaggatgatgaataggacagagacgaaaaggcagatattcttggagctggtcaacatccttgacattggatttaacctgaaattctcctaatctatttatacatttattgtactgtagtttaaaattcaatgacttccataaatatctaccataaaaatagatcatttatttcccgggtatgtctctccctgcacattttgaaggaagccatcatgattaccaaaatgtaccattactctcagagaccggaatcccagttggctgctgtgatggacagaggttcagctgggaatgtcaatggtagagtcttgaatgcactgtttgaaggaggtgactgtggtggtcgtgacagagtggactgggattgcagagaacaaaatttgtcatcagaggattgaggccagaaaataaccaatgcacagtggttaagtgaagcaggagtagcttttggggaatagaaagattcttgaagagaatggccagtgtgaaaagctggaatggactgagattggtccacaggacattgacttggccactctaaggtttatcatcattggtattgtttcatttttaattataataaaattataactcattggcttgaactcaaacaattcagaaacatgaaatataaattgataatccttcatttcccttcagtattcctttttctactccaaagtaactattaataccaaattgttctatgtcctttcaattatctctctttttaatatatttatataaagatatcaataatcatgtattataatataataaacattatataatattatgatatataattgtataatatcttgatatataatatatatcaatatcataatattatatatttatgtagcagaccttaatcattgtcctaaacccatgtttaaaatgtttgcattaacttgtttaaagacaaaattgaatctttgagccctcagccaatcagactagtgtgaaattttgtcttagttcttactggagcttccagatcctctccccatgagtaataactgtgcaaaggtcctatgtggcccaaagcattcaggagttagctccagtcttcggccctctctggttggtcctaggaggctcatcgtccaaggttttgttacatctctcccgttgactccaaagattaagtcacagatattattagacttacaaaaaaaaaagattttatttgtttattcagagagaagagcccaatgcagggtgccatcttagatcatgacctgaactgaaatcaagagtcagatgcttaactgactgagccaccaagacacccctattaaagacttagatgcagcacttcaagaagcacctgaggatctctatctctttattaggttttgagaaatgtctcattattatcaaagcttccttcattgacattcttttccccacctatattacacaattgctttcactaatttgtgccaaaaaaaaaaaacccataaaagacactagagaatcccttattacagagataaaagaactaaaatcatgtcaagctgaaattaaaaatataaccaagatgcaaacaaaaatggaggccataaaaacaagggtggagcagaggttcgaataggtgatatagaagatgaaattaaggaaaataatgaagcgaaaaagaagaaggaaagaaaggtaatggattatgaaggtagacatagggaatacaatgacttagtaaaagataataatatttgtagatagatcaatggaacagaaaagaaaacccagaaatggtcaactaatcttcaacagagcagaagagaatttccaatggagaaaagatagtctctccaacaaacggtgttgggaaaattgaacagcaacatgcagaagaatgaaactggaccacattctcacatcatacacaaaactaaattaaaaatggattaaagtcctaaatgtgagacaagaaaccatcaaaattctagagaacacaggcagaaactctttgaccttggcctgaacaacttattagacatattaccacaggcaagaggaacaaaggaaaatgaactaattgggacctcatcaagataaaaagcttcctcgtagcaaaggtagcaatcaatgaaactaaaaggcagtctatggaatgggagaagatatttgcaaatgacatatctgataaaagattagcatccaaaatctacgaagaacttttcaaactcaaccccccaaaaacaaacaacccaaattttaaaaaatgggcagaagaaataaggacatgccttttcaaagaaagcatccagatagcaacagacacataaaaagatgctcagcatgactcatcatcagggaaatacaaatcaaaaccacaatgaaattccaactcacacctctcagaatggctaaaattaacaacacaaggaacaataggttttggtgagggtatggagaaaggggaattctcttacactgttggtgggaatgcaaactggtgcagctactagggagaacaatgctgagattctttaaaaagttaaaaatagaactaccctacaatccagcaattgtactactaggtatttacccaaaggatacaaaaatatagattcaaaggaatacatgcaccccaatatttatagcatcatcatcaacaataaccaaactatggagagagacaaatgtccattgactgatgaatagataaagaagatgtggtatatacatacaatggaatattacttagctatcaaaaatgatgagatcttgccatttgcagcaatgtggatgaagctagagtgtattatactaagtgaaataagtcagagaaagataaataccatatgatcttatttatatgtggaatttaagaaacaaaatagatgagcaggcaggagaaggaaatgtagagtgagagaaagggaatcaaatcatgagagactcttaaccatacagaataaactggtggttgatggaagaatgtgggtgggggggtagattagatgggtgatgaaaattaaggagggcacttacttgtgatgagcactgggtgttgtatttaagtaatgaataactgaattttactccagaaaccattactgcactctaaattaactacttaaaatttaagtttaaaaaattaaaaacaattttaaaaatggaaaaaaataaactgactttgttgagggtattgatcatgaatggatgttgtactttgtcaaatgcttttctgtatctattgaaatgatcatatggttctttatctttcttttattaatgtggcataacatgttgattgattttcaaatattgaaccacccttgcaactcaggaataaatagcacctgatcgtggtgaacaattttctttaatgtattgttggatatggtttgctagtattttactgagaattttcccatccatgtttatcagggatattgacctgtagttctcttttccagttgagtctttatctggttttggtgtcagggaaatgctagcctcattgaatgaatttggaagttttccttactattctatttttggaatattttgagaagaatagatattaacatttcttgaaatgtttggtagatttcacccatgaaaccatctggacctggacttttgttttttgggactttcttgattactgattcaatttcttcgctggttatcggtctgttcatgttctgttctatttcttcctgtttcggttttggtagtttatatgtttctaggaatttattggcaaatcgtttttcataatgttattttataatcttttgtatttctgtgatgttggttattatttctcctctctcatttatgattttatttacttgagtcctttctcttctttttgataagtctggctacaggttcactgattttaatttcttaaaggaatcagaacctgatttcattgatacattctattgtttttttagcttccatatcttttatttcttctccattcttttttttttttttttgagagtgagagagagagcatgtgagggaggaacagagagagagagagaggatctaaaggagactccatgccaagtgcagagcccaatgaggggcttgatcttgaccctgagatcatgacctgagctgaaatcaagagtcagatgcttacaccactgagccaaccaggtgcccctgctgtattctttattattgccttccctttactatctttgggctccatttcttttccttagctccttatcatatatggttaggttggttatttgagatttgtcttgcttgttagggtaggtttgtattgctatatacttccatgttaggactgcttttgctgcattccaaaggttttgaaccattgtgttttcattttcatttgtttccatgtatttttaatttattctttgatttcctggttgacccatccattgtttattagcatgttgtttaagctttgctgcattttgctcgtgaccattttgcttttttttcctttgatttgtggtctttccggatttttttcttgtggttgacttcatttcatagcattgtgctcagagaagttgcacggcgtgacttcaatctttttgtatgtgttgaagcctgatttgtgacctaatatgtgatctattctggaaaatattccatgtgcaattgataagaacatgtattttgctattttagaatgaaatgttctgattatatctattaagtccatctggtccagtgtgtcaatcaaagccattgtttccttgttaatgttttgttaagataatctgtcccctcctattattgtattataatcaattagttcctttgttcttattttatatatttagtagctcccatgttgggtgcataaatatttacaattattagatcttctgtttggattgtccaatttattatgatataatacccttctttatctcttattacagtcttggttttaaagtctagtttgtcccatataagtattgctactctagacttcatttgacatccaaatgcatggtaaatgtttctccattatgtcactttcaatctacaggattgaaagaactaatgaaattcacccattctgttttctaagccaatggctttgggaaaatgtctctctctcccatgcttctccatgactatagccccctcctcttcatagcatcatgatccctttctccttgaagtcacatgtcccaaacccttacgtagttcaatgtggctcttatctcccttcagtggtggagtttgttctgtcatccttcaggtcaatttctggggtatttaggatgatttaatacttatctagttgtgttcatgggacaaggtgagcctagggtcctcctactcatctgccatcttcttctttccaatggaagtttgttcctcttaatcttttttaccaatttctcccatccctactcccttcccttctggcaactgccagtttgttctctgtatttatgaattcattttttgtgtgttttgtttatttcttcacttgtttttagatcatacatataagtgaagtcatgtaatatctttcaattgtagaagtttagaagtattacacagtcttaactatcaacattaccatttatgtctttttagttttttagtgctcttagatgtacaattgtataccaacatcacaaaaaatatctcaaccttcctttcttctaatatcttttcaggaaatatactgaaatgtaacatatgcagagaatttactactgattttaaatgtaacacataatgaatattcacaaagtgaacacacctgagaaaccagcacccaaatcaagaaagagagtttagttagaatctaggaaaatccattttttttccttttcaatatgatttcctcaagggtaatcagtattttgatttctaatttcatagattagtttttgtctgtttttgaattcacatatgtgggctcttttatgtctggcattttttgctcaccattatgtttgtgagatttttctatgtggttaagtgtatgtagttttagttaatttctatctcacttttattgcattgatttttacatttagatctttaatatatgtaagtattattttggtattaaactttatagaatgctcaaaatatttgttcctaattattttcactcacttctatgctattagcaaatgatatagaaaatctgtactgatttacaaatgcatattttccatatactcatagatatcagggaaaattataaattatctatgtgttcataatttatctgtttatttctttgacaatataataatgtttccatttttaaaacttattctctgcccaaacttcttatttgcaatgtttttcttcatttttgcatgtgttaggcctatcttaaattaatacctctgatttgattttatctgacaagatatctataggcttattttatccatcttcattatgataagaagaatctaaatctagtaggtcttgaaggaaagagtaacaaactctcctgagcagttactgtgatctcactctagtatcttctaagtaggaagtcaaagctttcaccgttccaaacatagcttcatagaagtcatgctattttttcagtacctttcccataactgttcattgaccaatggatataaagtccaaagtttagaaacggttgattgtatatctagacttaccttctgttcagttaaactttgcctagtacagctgcttctatgctcaggaatgagcatgcttttctgttcctctttttcaacataggtatagtttttgcttgtttcaacttggagattcaatggttatattcttccacgagacacaaggtctattttgtctaataatatttgcttcctaagctttgactgctgcattttgctcatgaccagtttctttttttcccctttgatgtctttcttcctattttctcttccaatttcatccatccccccactcctcccttctggtaaccattaatatgttctgtatagttaagagtctgtttttctcatgacaagtttcactcacttctattaattttctttgttcaagagatttggcaactcccttaagcaattctgaagactgtcttttagattgctttctgttttttagaagtgtatccctcccaggcagattgggatctgatagtttaaattattaatttcattataatttttagccaaaaaaaatctctgagggttctaagatattttctacatctgagtgatcagagtaggactgagccagatctaataggatccatgtcatgagatattaagtttaaaaaagacaaaataatatatagccttaaatgccaggatagtcattattctcaaggagatattggagtcttctagcattctagtaatataatgttttaatataggtgctggtgacatggatccactagtatacccactagtagactgtgcaaagttgagaagaaatatgaaaagaaataaatgagagtggaaaagttaaaatatatatatatatatatatccctccatggaataactgcacttggctaccttcatcttttagatgttctctactcagaggaacaaagaaaacttggaaaacattacaaaatgagatgtttaaggtagtgattacaagactccattgaatcacagaaaagtagtcttccttaaggcttcaataagtggaatagatagatagatagatataggatagatataggtatattggtgttttcctaaaagaacagaacattggtaaaatttactccactcttttccttttatgaccaattgcaagtgtgtgtgggtagagcaggtgtgataagcatcactatggaatcctagtatcagcttcaaatttcttgatatccagccacaattacacatttatctcatgagagaagaaaggaaactctctcttcccaccaagaatgatgatgctttgtccatatccccacactgatgttactgtgtaagattagggactctggaccaaaagtgtccaggtttcagatgaatgactttctcctctccaggtctgggttctggtcctcatgttttcatggtgggtccagaagataaaggaataaggctgacatgcagaggcaagggatggtttcctcagcctgaggtacaatggacagatgcaaggggagagaagataccatctctctctgaggatgagacccaagatgatgatgggttgtttcaaatagaggcatccctcattgtgagagacagttcaaagacagaagtatcctgctccatgaagaaccctttctttggacaaggacaggtggaaaccatttctattccaggtcagtgttgttcatttgggggacagaataagagtaaggagggaatatttaggagctgggatgggacaggattattttgtatatgtttttaatcaggttttgggggcctctgtatcagaatccttcttccctaggacctctccttggaagatagcatttgctgggactttcctcatacttgggggttttgtggttgctgttatgtttttggcctggaaacaacaacaggagaagagaagagtatgggaagtccagaaggaaaaaaaggaagaaagcaaagccaaaggtaaaactgtgactcagagttggtgggatctgtgaatttatgagtttgttagctgtgcatatggatggaatcttttggaaaatagaaacatgattgtacttacctagagcctcaagacttctagcaagacatgaagccaaggacctttatgagaaaaatattataatagagtccaatggaaagagaaaactcactggtataaacatggagttagaaaaaatggttatagtattctcagggtgaatttcttgatctaggtatatggaagtagcattcaggatctggatgtaggtaacacagtctagaaaataaaccttggacttgttatctataaaatgttttgttactttctttcctttttagaactgcttgaaaaagagcttggtaagttttccatttttctttgttctagtaaatgaaatagagtccctactgcatgctgtgtattttgcatctcacaggttattattccttttcagtcaaaaggaagcaattgtatcaacaaggtgagttatatcaatgttatagttggaccaatcatctcatctgtctttctgttctgatcatctcctgttcaccttgctagtgagggaagaattccctactctaagtaagataaggtggttatatacaggacactcaagactggacatatgagcttgacagcagtttagtaatcacctatactcacaccctgggggaggaggacactacaagtcatgtggaaccacatgttgcacttggaaacagagtgaagcagcaggggctgagggagacaagctttttagtaacaacaagatgaggtgctactggtttctgtggaaatgtgtgactggcttgtttgagtaattttgcaggctgacagggaagtgaaactcattagtttgaggaccgggtggggggggcggggttcagctggcttgactgataggaaaattagttgagtgtgaagtttttcctgctgagtggagacatatctggtgagagcaggggagcttacaggcatttagagccgtttgaggcttaaagacatcagcacatgaaattttagggtttacagtacactctcacaaagtttatcttctcctctcccaaatgaatcagaaccttatattttatcacaagtatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttatttcacacctggaccaattaaaattatatgctggtgagtaattgatgttgtcttaggacttcagacacctcagaatttcatgaggcatatcccgggcaattttcagagatgtgctatattctggaaattttattttgaaggccgggaggagtccaaaaaaataagggaataagagtaaagcatcccactagttgagaagacatgtttttgatatagtttcccatatggttttttttcttttctttttagactggagaaaggaacatttcaaagtaggtgagtgaccttattattttgtcccacataatctcttctatacaaatgagaaaatcttatatttatataaactcccaataaaacctggttgggtattcatttcatggctttcagttcagtctcaatctcatgctgaaatttgaatagatttcttacttttctggtatcattcattcattcagcattaatctatagaactatttaattaaggccaaataaataaagcagatctgatttctcacttcatgggaaagtacatgtacaaattgtgatgaaggttataaaggaataagagatttccatgagaaaaaatggtggattgaaggaatttccctgaggaactgactttaatctgagacttaagttatatatatggatttattcctgtgaataacattgtgaactgtaagggcagttcagtcagaaggaagtctgttacaccaacctgagacaaagaagagcttgatgtatcccagtgtaagtggaaaaatcttagagtctttcaataattaattattagttgattatcagtttctagtgcatgttaccataggagatatgtggatggacacaagacagaacataaattgttttacctcctcctctgtggctctccctcctattttctttcattctcctttccctatatttgcatctttcctaaggccactgagatatgacctgtattcccccctacacctgcagctgctattactctggatccagacagcgctcatcccaatctcatcctatctgagaatagaaaacaagtttctttaatggaaaatgttcctcagaactgtgatgcctcagtatgccaaggacaagaggaatgtgaagctgtcttcagtgttctgggtcggaattgctttaatacaggaagacattactgggaggtacaagtcaatatggggacagtagctggacctgtaaataaatgggctgtgggtgtttgctcaaatacagtaagaagagaggggtggtttgtagaaggtccagagaagaatatctgggtggtagcatatgagaaaggagaagtcaagtttcctacctccccagagtctctgtcactgaagcagcatcctcaaaggataggagttttcttggactgggaagatggagatgtgtcattttacaacatggctgatgggtcccacatctgttcctttactggacttaccttctatgagaccctctgtccttattttagccttcggggcactggcacatctgtgaccatctgctcaggtttagattacactgaaaattgtcctgattcttctccaaatacctctgtaactcatttaaggagttgtgatacaggtgccccccaagaagctaagcctctattacttccataagaagtgtcagcacacgtgctcaggcttctagtggtatgttctccaagaaagctgtccctgtgtggagagtaggtcagcttcactaagtatgatttcaaccccttccagagaggaagaggcagaaagaggaatgggacaactgcaaaatgtctgaaggaatgtcctctcccgttatttttggggaaagacagcgtctttttgagtagcaacaatttgtcccaagaaaattccaaacaaatgcatgatctctcttctgttctagcactcaatgtgtattgaaataaacattttttgaaataaatatttttaacggtacattttaagagaaatatctctcttcttactattttcatatgaaggagggatggtgtttgaagggaagaatcatagttgagagaattcttaatacatgttactaatgttggagatacacaaatttgctcaagtcttgtgaaaattaatagttcagtttgcctttcttcaggtccatgcccatcaacctctaaacctagagtttgccatggagtgggcaggatggatgtagaactataaaccatttaatcagaatcccaggccttctgtgagggaaatcacacacacacacacacacaacacatatttttaaacaaaatctcattggttagtaagtactgaattgtgttctatatgaatatatgaatgaaaaatgaattgatggaacacctgggtagttcagtggttgaatgtctgcttttggctcagtgtatgatcctgagtctggggattgagtcctgcattgggctccctgtgaggagcctgcctttccctctgcctatgtttgcctctctccctgtgtctcttatgaataaataaataaatgatctttaaaaaaagaaaaagtaattgatgttgtttgtggtttatattttcagggaaaaacagtcaaatatgtatgaagaaatatttacagacttcatggagaaagtcattgctaacactggcatatttttttttctttctgaccatcttcttctcactattgagagtttctttgcctttaatgcaactaaggcttcactaagtttatgtcttcaaggatataaaatataagcttcttttgttaaatgagccccctcttcgtggagctagaaggaccacttagattttctacacttttaacagatcttcaaaccacaactcccattatcaatctctctgggaaaatatatctccttcgcaaaatttcattgacaaacttagaggtaaaaccagtattggaacctaggaagaatgaaaccagagcccagaatattaactttacagacagtaaagggaggagttatataacaagtaagcaaaaatgaaggcaagacagaggtaaatgaatagtggacaaatgttaatagctataatcaaatggatttagtgaatgagaagggatttctggacatgagaaccctttacatggagataaccacaaaataggaacaaatgggattggaatgatatagaacagaaaggataatgggttccattttggatattttacttttgttacatattcagaacaatcagcatgaggtttccaaatgagcttttaaatatctcacctgaagaaactaaatccatattttgttctacaatgagattccttcacctgtcattcctccacttttttttttttagaaaagtcagcataaacacttttattgtaattataaaacttgaaacacttatatagtgtggggaggtgtgagatagacagcaataatttctctcaccaaataactatacaggacagcaaagaggtgagagggggacaaagagccagaaaactgagctcagcagggaaagctgaacatcaaaaaccaggagatgctaaagctgtgatgaccagcatcattttctcaagacaacactcaaggatttgtcatgatggctgggctttcattgggtgtctacaaatagcaccttcaatttaaactttcaattaaagttcttaaaatttgggaagtgaagcttggatacctatgagattataaaagtctcctaaatatccatcagaaaaagcacagagtggataataataataataataataataataataataatgcatcaggctacaaggaaggcttcagagggtcctgctggcctggggacagatacctgtagtatccaacatctcagtgagaatgatctactttcaaaaggcatagggtttaaggggaggctgggaacagtcagcggaggcaaagcttcttcccctctccacttcagtttcaagtagagcttttaattagacccaaggacatccctcaacttggagaataatttgccctcaacagcacctcaaatttgctataactttgttatgcagcagcaaaaatgtttaatatataatagataaaatttcatccaataaaataaaatattcttgcctcctcccctccaccatcaccaatttctatcctaaagttaacccattatttgtgctgttaataccttaccagtacttaagtggaaacctagatccaaaagattgaaactgaaccttcaccccaaaacaaaaacaaaataatatgataaacttaaggttttggcatatagtttagtgtcgacacatagaaaggagaaagggaaagagcaaagctgagtgtcagaacacattgagtcagtgtcatgtttatacaaagagtgtagtggaaagtcaggaaaacctccacaggattcatgcttgtgtctagatgcatcagatccctccaggcacagcgaatggggaactcaggaagcaggccattcttgtcattccagtttcagaagctctacgtcaaagaggagagtggcatttggtgggatgatgactgggttcttggtggcatcacacatagatgtagtctggggatatagtcagtttggctctctgacccacactcacgtgggtaaccacttcttcccagcctcagatcacctcctgctgcctaacataaacctaaagagcttgtttctgttcttggaagaatcaaatttctttccatcttcaaatatcctcaggtaatgcaccatgtaggtctgactgtgcttggggaaggtgagcccaactctggggagatggtctcacctgcactcccatggtgccatggtggcagacactgatcaggcagactgacgatcaggtgacctgggggcggctccttgactctcaaatgttgttgttgttgttgttaagtaagctctatgcccactgtgggcctgaagtcaagactcagagatcaagagtcccaggcttctccaactgagccagccaggtgcccttgctcctccattcattttaatggattttgttcttctaagcttcgagactggagatcaaaagctagaggtgggcaatgaaataaaatgttaaggttgatgttatattggaatcatagttgtagaaataccagggataacatcatccatcatatccttatctctaaggatgggtaaatcaacaagcaatgaagggtctccaagtagcccacagttcctgacaaagtagtgaccatgaactcaccacttgactccattaattaaatatttactgctggactgctctggcaatcccattctgagtaagctctataaggtaataataagacattcaaaaaacaaagagaaagacttaactagaataaagaactatattagagcaggaattatgccttgctatgcatttgatctctacagtccagcacagggtattctaaagataaaatattaaataaatatcctatttatgaatctattcctctatttcataaatgtttattgatcaactaatatatgtcactcttctactttgtgatgatacacacacacaaaaatatcactgccctaaaggaacttaatgtctactaacaatgaggaaaaagttctgcagagaggttaacaaatttggtctctggtttcctctagtcctttcctttaaactgagctgcatccaatctatacatctcttctgagagtcaccatgctttgcatgactgcaaccagctccctatgcattaggagtgacagggagctggatctttgatgggccaatccagtcactcatccatcaggcatagtgactgcatcagtgattagagtgtcttgatcaagccaccaacattctccttcctcatggtttttctttgttttatgattttatttatttacagagaggcagagacataggcagagggacaagcaggttccatgcagggagcctgatgtgggactcgatcctgggaccccaggatcacgccctgggccaaaggtaggcaccaaaccgctgagccacccaggcactcccctccaaggtttttctaattgacattggaactgagaaattaaattaatcccctatttggtgagctaaagaaaaacatatttcttaatacatagtgaaaggattttactgataaacagaattttttttgagaccttcctagggaaaacctatatatttacatattgggcctacacaagcacataaaactaacatgcaaaaagttagactgatcatgaaggaagacaaaaaagaggggaggtagttaaccttcagattttatcaaataaaacatttttagttcattaaatcaaaatagaataacattaaaaatattttaagaaaaaaatattttaaggcaaagtcaacacatttactaataaatttgacttcaaaaatataaaggacatataagggtatattaatgtaccaaaagtggtaaatcatttgtcaaacctcacagaatgtacacacaaaaagtgaaccttaatatggaccctatatagagattatagttgaaaataatgcatcagtattggttcatctgttggaataaatgtaccataccaaggcaaggcgtaaataggaaattatggggagagagaggagggatatggaaatgctctggatttttcactaaatttttcaataaacccaaaacagctcctaaaaaataaaaattgttaatttaaaaaggaataaagtacagtacatggtacaacatggatgaaccttaaaaatattaagttaaaagaaaagccagacacagaaaatccatatattttatgttctatttatatgaaataactggtataagtaaattcatagagacaaaaaaatagattaatggttgccagggtcaggggagaagagaaaaatgggtagtgactgcttaatagtttggagttttcttctggagtaatatcctggaactggatgttgatgatggttgcacactattgtgaagatatatataccactgaattgtatactttaaaatgatgggttttatgttatatatatttcactactgaaaaaatttaaaactaagtcaaagaaacgtaggagaatatagtttcaaacataaacatatgagtttaaaaaataggaaaaaaattcagtgaaccaaaagagacactacaggatgtgatagatgagtgattttcgaaggacagtaatgactatcatggctacctcctagaaagcagcagtgtcattaataggaattcctaattctcacttcagaagatttcaagacttttccaagtctttcttttccatattctttcttcttctacagtttctctcctttaatttattatggctttaaaatatttttactatgtgttgtatttattgcttatgcttatttattttataattattaattttaattgtgcacttttttgctctaaaaataaaattggcatcttcatatacacaatacaaaattttctctttttttccagttttattgcaaaataattgacatatatcactatataaatttaaggtgtgctgcatgatggctcaagttgcaaatattgtgaattgattaccacaacagatttagttaacatctatcatctcatatagatacaatgaaaagaaattaattttcttcttggactagaatttctttttccttaatttttttttatttaggtcaacacacaatgttacattagtttcaggtgtacaacatagtaattcgacaagtctaaacattatatagtgctcacaagtgtagctaccatctgtcaccatataacactgttataatattattgactatattccctaagctgtatcttttattcttgtggcttattcattccataactagaagcctgtacatcctgctccccttcacccattttgcccacacccctactccatcccttctggctaccatcaatttgttctctgtatttatagtctgattctgctttttgtttgtttattcatttgttttgcttttatagtccacatataaataaaataatatggtatttgtcttggaatataatttctaaaaaaaatttccactccaagtctccactttctgaaaaaatctggcataggaattctacatttcatatgatattcaagattatatctcagtgatcagatttcctccttctattcagctttattttcttttactcttttttacctgtatttttcacttcctcatacccacttggaaaattgtcagcttcataaagaaacctatcaaacagtctaggcctaattacatttcccattggattttctaaccatatcaggttgtgattagtggcaggctatcagagagcttgggatagggtatttctctgaagggatcagtctctagatcagatttgaagccagagtaacattaaagcatcttgatttgatagctggatgatggtgtgagcccattcaagcagctggtaaaagaagaagactgggacttggaatacaagctttgtttccagaatccaaggttatttttttcccttggagatgttgcaaaatcttctgggtgtaggaaagttgtcaggagaacctacattaaggatcaaaaaatgaagatgtatagagtttcagaaaagaaaagtgtatacagaacacttgttggtcatgttataaaaggaaaagtgtccagagactagtcaaggaagattttgacccttcttagagccatttttatggagaggatgcatggaggaaaggtaatggcccagtactggtttctataacaactcattgtctgaatacattctcatatgacacagggatgactccctccctccttatatagtccttggcaatgcctgagacccatacagtcttgtccccaacctctatttctcagtaccatctccctgacatgaacccttcttggcctggcacattgagcaagctgtcaaatctctgtaggatgtatggctacatgaatgttcatgggtcacatgcttgtatccctcagaaaagatcagtcctgagtgagtggtatttagatacaatgtcatatttgctgtagagaaagaaaatccattctgataataaccaatgtggcgagtattttaaatatattccatgataccaacatccaaacaagcaaaccaaagttacagtgacataagaaatttgaagtgaaggaactttatagggcacacaaaacaacctatcacacatagaagttcttcatccacagagcaagaatcctcaataagcaagttaccatatttttaaagatcttagtgaaatattgataccaacagaatctcagtcgagtctcaactctcagcctttaaagaatggatggctatgctatttttttcttctcccttaactaggtaacttggaaatgttaactgagggatcaaattattgtcttttaatccttttgcttctattatcactgtaaattctgatatcattcagcactgatcctccttgaacgtaagccatggactctcatgtttcattaattgttgaatgttcactgaattcctctcctatgtgactgctgaaaagagaagttagggaaagtgcacagcaaggctgctcctacaaaaggtactccatacttgactatttacctaacttacctttttcacagctttttctcttgaccaggcccacaagtgcagcaagaagtaataccaaaataagcactatcttccatgaaaaattcatcatgggctctaaaatggaaaacccagaatcccattaagtcatgaaactggaaaaattccaagatcgttctttttatctaagcagctcctcagttagagaggagggtgagaagtggatctctcaagaaggaagctgatctgtccctccctactctgcaaaagctgaggaaagacacaaggtttatgctagctttaccctttgctcctgtaagaaatacacacacatacaaatacacacacatttctttcccttctcttttccaattatatcaccaccatcactggaatgacaagaatagcaaaaggataaaattatttaatccacaagcatgaagatggtattaagaaaaacaagtttctaatcctgaagacaattcacaataaagaaaaaaaaacccaaagtgatattggcttcatatcagaagaagagagtttatccttacagtgatgatagagtcaattcttagaagttagtgtatgtgcaacaataaaacctgagggctttagtcaagtcaaaggaggtcagtaggatctccaggtgtcctgatgatcagttttgtaagagatagcagatgattttatcagagagaagaaaataaaaatttaaaaatagtagagcaataaaataagtttgggtttgtcttcatatatatttcccaaagttgagagaaacacatggaatcaccaacctgagagagaaaaatttgccattttctcctcgtcaagatgggggttgctaatggtacaagttacattcacaatagagctattcgtgaccaatagagatgtctccacatggaatagcccatggctgccttcagtcataacctctgaaaatgctggtattatctttccttccatgtccttccactttacatggggctctgggaaccacccttctgaactgcatatcagctctatttctccatccttttgttcttttatggtgatctgcggagaagaacccagacctgcggagtggagatcaaggaacaaaacctagagtgtctaataagtggttatatagtcagtaacttcactgagaagaaagagggggattcaaaggcttggttgagagaacaaagcttataggggaattaaactccacttagggatgagactagctggagttgtttctaggtttgttatgctcatttatttttatttttatttttttgtgtgttcctaaagtcatcctcagagtcagaggaacaataaattttaaatccagtcttttcttttctgtatctgaaaacaaaatagttttgaccaagacatgaatcacatggataggatgaaagaaagtgagtaaaagaatattctcaaatatccagattttataaatatgtgcatccagtggcaaaaaatgatagagtccatttaacttctcaacatgtgcccctctggatatttcatgaatatgtttatgattgagacccaaaatcagtgggagaaacaaatcaattatgcaagatgttggccttatttgctaaccttgaaaagtcaactcttattcacaaatataaacgggggggattatgatgcagggagcaatttagtctttcttcttccatcctgccacttctgttgatacttattatttttgcttgtatgtgaatgcagtctagtcttcacataactattctacctagtaactatatacattgtccagaattttttttcattgtccagaattttaagaacaccctgtgaaataatgagttctgtgtaaagttcgggagtaaaattctcaaatttcactaattgtatggtcattttacagagatctggggggagtgtacaagttctacacccagagaattaaatctggcccatttaagcccattaagtactgaactttaagtatgtactacagttcctatgcatataaatttgacaagcgaatggatattccaaaaatttcaagtgccaggggaaatttccaagaactagcatgttaaagcagtaggaagagaggttgaatccaaaatatctggaatccttacctactacctttagatcgaaactggcctcctgatagacaccatctttttcaaaaaggcaccggtactgcccatcatctgacactgtagcattgtgtatctgcagagtcagtctcccttcctcagcggcatcattcaccaacactgtccttcctctatattctgacatctgctcttcagtcacatgttccccatccgcatacacataaacagcaggataacggtgtgattggatccacctcacctccatgctttgtgcattagtctcaggggacagataacaggttaattgtatgtcttctcccactctgacaaggatgggctgggaaggtccaatcacttttaaggaagctatgagatacaatagacaaaacacaataaagacacaacatggagtaaatagtgtcatcagtaagaacatctccagtgggatttagactcatgggcatcccggggagctgtgaggcaccaggtcatcttgcagagagagggaggtttcaggggaatcaggatagaccttgtccctgaaaaaaggaactattaatagaacccacacctgcctctacctattttattcagattacaacccaataaaataattttgcagttaatactcctagaataaaattaacattttatcacttcatatctgtacgaccaccttaaactacttctcaatctgtgtatacctcaatttcttaaactgtgaaataaatatattaccatcaaaatcataagattgttctgagttaaacaaaataatctatataaaacttttgggtgactatacagtgtgagtgaaggcatgcagaccatgagacgtgaaggcacagaatccaatcccattgccttgataaagagaagggatgatgatgagtttcaggtggatttttagtaatgaaatatgaagaaaccttcccctggtttgatttttataccttataagtcagacccaactaccatattttagttccctgaagtcccacgtatgtggagctctcaacatacaccaggttcaatgtgcttagattattttgagaaacattgtaagagcaagaactggggatgttgccaaaatacaaaacacaaaacaataatgaatacataaaaagtctaatactcccattgtgaaaattggagattttccctgatgtctttcctggaccccaaactatgttacgcttccagttcatcagtctctggccatgctagtttttctctgttctaaattgagagtcatccttatctatcaaatgataaaaatgctttcacataggttatgataatttctaataggtatatgggcataaatttgtatattgttacatgggagtcaatgaccaaagagaaaatgtaattagataaaatctgctaggtacttctttagaaagaaaacttacacaatattaattttcagattattcccttctattctagctaaaatttgactcccaactatttccagcattttgtttgctttatctttcaattttacataaaacaatatctccattgcaaatgtatccattaaaatctgaagatgaaagtaggattcagaaaaaattcaactagggattagtctgctgctatttctccttccatatattttacagtaaattacttagtaaaatagacaatttcctaatctccatcacccatataagtagatgcattatagatatatgaaacttctgttatttcagaattcaagtagaaaataaagtttaaggtacaggaaaaaaatcatgcaactcaatctgctaaaaattgatattctactagaatacaagctccttgagataagctctgaataatcttctttagatacttttatccatagccttccacacagtttgtgctcacatttattgttttgttttatttggggggtattatatgtatgttactgaagtgccctgaatgttactgaaatattcactgaaaattaaatcctttctggagtgtgcagtttgctgaataatataccaattctttgaaacctgataatctcatcatcatgtcatataatccactttcaaacagcatattcaattaagatggctctcatttcctcaatatgctatatttttatattatataatatattaattatatcatatcatatcatatccagagttttagagcctgacactacatcagagattaaattaaacatggaagttcctcaagaagttaaaaatagaactactctatgactcagcaattgtgctactgagtatttactccaaagatatagatgtagtgaaactctggaacatctacaccccaatgttcatagcagtaatgtccacaatagcctaaccgtggaaggagccataatgcccttcgacagatgaatggataaagaagatgtgatacacacacacacacacacacacacacactatggaatattactcaggcatcagaaaggatgaacacttaccatttgctttgacgtagatggaactggagaatataatgttgagtgaaataagttaattggagaaagacaattatcatatggtttcactcacacatgtaatataagaaatagtgaaagggactataagggaaaggagggaaactaagtggggaaaacttagaaaagaagatgaaccatgaatgaaccatgagagactcttaactctgagaaacaaactgaggtttgctgaaggggcggtgggtggcaagatgaggtagctaggtgatgggcatgaaggagggcacatgatgagatgagcactggatgttatattttggcaaactgaatttaaattaagaaaataaaaacaaaaaaattaaaaaataattattgttagaaaaagaaataatctctgaaaagcatttagcatcacaccaggcatataattaatatttttaaattagtcattatttttataataagattatttgatagagatgagtgggggatgggataggtgagtgataggtatgtaggaaggcattttttgtgatgagcactgggtgttggatataagtgatgaatcactgaattctactccagaaatcaatattgcactgtatgttaactaattaaaatttaaatttaaaaagagattatttgccatagtgggacttctacagcaagcttagtctgccagcagccacctgcagtgggaccttgtgtttgagttctaattcatggattaacacagtggtatctgtgaagctcctggtgtcctcaatcaacagcactcaaagctcctgagggcgcagccctgtatcccccacccaacagggagccagggggagctccatattttcatcatgttttactgtggtcccagaaggtcagcacaactaggaacaacacaacatcagattgtacttagcatgctgggtctccaatggacctgtcaaattggttcaaataactcagagtgactcttcacctaaagtcttcctgagggacagagccatgtgtccacctgccccaaacactggctcgacattctggtctgtaactaacaagttcttctggtcaaggtttctgtcttattataagcagatgctgcccaggcaacaggggatctgacttggaaggtacagcttaccagggtgcagctgtccatggattgtggaattacctttgaccctcctgaggcccttctctttatctttatggcctaatgaggtcgaaagtgtcacactagaactctggcagagattggggtgtgtttgccatcctgattttcctcaaaacttcctacttgggctgaagagtatgctcaagctcacctaatgtgcacataggtatatgcgcacacacacatttctgtaaccagtgagtggagggagagcaggagattagtggaaaacaagtgatacaaggtcatatgtatctgggcaggaaacaggctggttatcatgggctgggagaagaggtcacagaaaggaggaagtggtaaggaggcaaaggagaaactgaaagaggctcagatatcagttggttactttttaaaccacttatctttaccttaggtacagtaaagtaatactgcagtccaactgttaagtgaagaaagaaaaagaaaaacaggaaaatgattgattgcctcaggcagtgttccaggctacatctgggaaagttatggctccctcccagtagtgatgaggtttggatccactggggtgtgcagaaaccacagcagggccagagggttgaggtgacaggtggggaactctagttaccatgatgacactgccttcacactagaaagattttaaaagggttcccagagtcccacagtctgttctataccatcccttacacacacaggtagcaccctttcctccagccaaataaagcaatgattatgtctgtgccctttataggtgtccatctgaggcttactggggtccccgtgaacacttagtcatgaagtgcaaaggtacctgagggagcctgtggaggcctgtgttttgtcaatcccctctgatactaactgaacttgacttggtaaagtcatgcctcagtttctcttctggatcacgagttgtcatggtagctcccactggctttgtctgaggttattgcttccctttggggcaagcagggtctcctctatactagcacatccaatatctacttacctagctcattctggaatttctctggaaaaaaaaaacaagaataatatattaaggaatttgatctaagggaaaggagagaaaatatttaaaaagaaaaaaagttctaaattttattgataagctcagttcataaaaaaaattttttaagattttatttatttattcatgagagacacagaggcagagacaggcagagggagaagcaggctccctgtgggcagcccgatacaagaatcaatcccaggaccccaggatcatgacctgagccaacagcagaggctcaatcactgagccacccaggtgcccccataaagaagaaattaaacacagaaaaatattccttcccatggatcacctagtgatccagctgtttttccttttatttccaataaaagcctctcagttctattaccccaccatagtttatttctgctgatattgaacatattgatatttaatatcttgtcaaactgatacatattcttataagtgcataaaagctataaaaatatatggacataggtaattatcacctataattccaaattgaaagataaaacacatataaagcatttatataatatatattcagctgcttttaacattcacatgtgatgttttctttaaattatttaatatatccatttatataagtaagaataactaaatctctatatctaaatatagaagatataccaaaagtcttagtgcagttttaagttatttaaagccattattccttatgtgattggaaatgtttatagatagatacataggtgggtagataggtaatagatagatgtaatctttatataaatagtccgtcatgaggattttttcaaccattaaaatcatttgaaaatagcatgtttcatcaatgctataatttatagtcacataagatacttaacactccactattgtattgtgcctttttaactgttgttttattgctatttataaatgaggctataagtaagatactattatttaatagctgtctccatctctgattatcttcacatgacaggttcttaaaagtaattggcacaatgtggtacaggaaagcattttgattgaaagaatatagttttattctctttatcatgtaatgtatatgtgagtaaagaaaattaattcagaaagaagaaaaggtggaatttgaaaataactaaacaaattaataatcactatttaataaaaatatagtatatatttccagtcataaatagtttatactttttaatacatattactaaattttagatattttccttgataaaaacatattaggtgctatggaactgtcctttgagactttcctgctaatctgaatacactggtcctagagacagagctctgacctggaatggagatgactgagctcttcttctcattgaggatggggttgtggatgagacaggacacattctccacagagtcattcctgaccacaagagtggcttccacatagaacaggccattttcatattggattaaatgctcagaagcagccagcaacttctctcctgtgatatcttcccaataaacctgaggttctgggaaccagccttttgcagtgcacacaagttggattctactttcaacaggtgcctccatgtggatgtaaggggcagaccccagacctgtataggaaagacacagccctgaggcctggagaccatggaagcacaaatcacggaaaccaagatcccagtaaaatcgctcatagggagagggtaggagttcatgggtccagggaacaagtcatccaaaagtcttcttcccattcaaattggatttcatatacactttgcttgttccccattctggatctttaaactttagcatatgagcagtatttttcttcagatccagacaggaggagaataagagaaagggacataatgacattttgcttatgtcactagaactgccaacaaagatgtgttataaatttattcattgaactttcccatgctacaaactctgtgtggcattttagatgatatcttgactctgattaattagaatgtttactataaagctagaaatcatctcaatggggattactcttcacttttttctgttggtggttgtgatcttagggagcaagcagataacctgggcatgtagatgcccttgaggagccttggtttctaagtattccttacaatcaatgggaaaatgttcttgagaaatcctagttttatgtaatcatgaaattctttccttattcaaaatcgctctcaaacccaaacaaagggactatatttcccatagatgataactctatcacttgctgagggaaagagactcactcccttcatctacagccttagaaaatgtgtggtttattttcaaaggttcctgatagtgaacagctgctttcctctctccacacctcagaaatacatagattcttccatccatcttcaatcacctagaacataacaataataatcatgggtgttaagaaaaaatggtgttaggaagcagccttagtctgagtcagagatggtaatatctctagagaactatttccctgagaagataaatagatttgcctgtttttctctttagcatgtgggggaattattcttgccagggaattattcttgccatataattatttacttttcagatacgtgtttttcccctaggacaaatagttttgtaagtcatcccctttttcttaactgtttcccactttgctaatacaaaaacatcagacgaaagcccgtcattcacagtggggatgtccaattgcatctcaataaaaacataaagttcttaacctctttgttcccagcattagctttctaaccgggagcattccacaaagaaagacaattttcccatttagttactgcatattggagggtgggtagataacaatgcattccattgagatatggttgctgggcagttagctagactcactcactctatgattgacctgccctaacacaccagcctgatacagcacaaatttgtgcctcagtaaaattgctaatgaccagatgtcatggattgcaattagtggtcaagaatagtcagaatagtcaatactgtgtaagttaaattcgagaagattgtttataagtgagcttgctttgaagacttcagaatcacttgccttcaaaggaatcaggacagaggactggtcattaggaattacctggaggattgaaagggaatttttcaacttatttttcagttcattgccataagcttaccataaattaatatacttctccctccaagactctatgtcttttccaagatattcacctgtaactttaagctgcaagcttgtttcttgacaatagttattctcttggatacagcaccagtattccccattatcggatggctggatattgtttatcttcagagtcacttttccctcaagaatgccatcctttatcacctctacccggcctctgtactcctccatctgcatctcggtcacatcagctccatcccagtgtgcaaacacaggtgtgctgggctctgagcggtaccaggtcaccttcatgtgcattgcggtcctcttggggaggagctgacaggttagtagggcatcttccccaatcctggccaggataggatgtgtaggaccaatcactctccagttttctacaaaacagagtgaaaaagaggtaccagaaaatgccaattggaagattaatatgcttgctttgggatgtccaatctatcaaaatggaggcatctggaggagggagggctttattttcagtgatttagagaaatctagcacaatgctttgcacatttggctgttaaaaagacaatttcgtgtgctgaaaatagcatgcagttcaaaaatttgagtgttagtgctaaatctgtcaccagctgtgtgatttggggggacaaacccattattttcagtgaggtctgagatttggaatctcaatttcttcatctttaaggtaccaaagccaccatctctgggttgtttttattttcaaagaagttaatgtgtaaattgatttttttacattgagaactttgttcgtgttttatattttatagtaatttattttataattaatgatttcactttatattgttagtgactgatttcataatcatttttcctaaaataaatttgttcgatttttcagcttttcaggagtaaagttctagttaagaaactgggattattttttaacttaaaaagatttttgggtccggggcgacagaacttccatcctggaatcatggcccagttcatcccgtaacctcgctgagaagcctccggtgctggtgaatgctgctgtgacttactcgaagcctcgattggccacattttggcactatgccagggttgagctggttcctccaacccctgctgagatccctacagctattcagagcttgaaaaaaatagtcaagagtgctcaaactggtagcttcaaacagctcacagttaaggaagctctgctgaatggtttggtggccaccgacgtgtggatgtggttttatgtcagtgagatcataggcaggtgtggcatcattggctataatgtttgaagaccaatctttaacatctctttctatgtggcttattatttgagtgttcttggaccatgtgtgatcagactggtatttgaataaaataagataaggtataaaaaccaaaaagatttttggtctggaacaggcaagactccagttactggagctttatatgtacaatgctgtttttgcgaagatttttttgtgatggattaaagacagcattttgtctagagaatctgtgccttttaataaaatttttggtcatgtttgacctttttgtcattatctgcaaatcgaaaggatatttaataatccaggtgttatgatgtttaataatctcataagtcatatatattatattctttctcttcctaaaatgctccagggccacttgcacttgctctgccacatccaatcatcccaagaaggaacttcaacttgctcccttgctgataatatcaaactgatgttggtcaacagctcagtatagaacttacgggaggcccgcttgcattcttcatttatagaatctaaatacgaagctaaatctgaagctaatccatctgattaacttcttttacaggttaggaaattgatttatacagagggctggacagcctcctgccacattacatagcttctggcagccctcagtctggagcctgcgcttctggtcccctgtccactgttttttccacttctgctttgctgtacttttctggggactctgatatttccctctgacactgaattttcataatctttttataaggtacaattcagccagtgagatttccaagaaatggaaatttctaatttcttgtttccaagtatttttatgctgcttaattgatggtaagaagcagccatttttcttgttcccaaagtgctgtcctgcatggagacagaaaaatagatgaataacttaatgtgttctaaatactacttcatgtgcagcctcatttaattctaaagcctgtcctagcctataagacataggtatgttgttattcttattgcaaagatgaggaaactaaggcagaaggcactcaagtaacttttcaaaggtaacacagctggaagttgaggaccctctggaacacagatgctttggttcttggacactcagtccaatattgtcctatcccttttgatctggaactctgcatgtggactgtattgctggggcatcggggtatacagtaaagagaagaccggcattctacctggctgtctcatggtgagcagcacaaggaagaaagaggcaactgcacctgacagactgtatcctggaaaatccaccattctccctgcaaaaaacacaagagaaaaatatgagtacacccaaatgaggctataatggagcaagctcactttgtggttttcaacagctacataaccacaatgaggaatcaacaacatcagcgcctccacagtcaaacaaggaatggatttggttcaatttctctatggttacggatcatttctgactgcttacttagtaagcgctgtgaagtacactaagtacttacttagtgtgttgtactttaaactattttttaggcctctttaaactattttttaggcctgagggaagatttctgactgaaatgaaaagccctcctgagttaaagtgacaacaatatttatttgtttttaaaaactttctaaggtccatttattctgagcaggcagaaattatagggtaggattcagatattttttcttgccctcctcccagcccctcctgcaaagttcttcatcactaccctctcctagatgtacaggaaagagcaagaaggctctgcatcctcactcttccgccaggaagccatcgctagtgccttgggagaggccaaggtctggggttcaccttggaaagggaaagaaagagtgatggaaatggtactacagtaagatacctccaaggagaccaccctcaatggcctttcagtgtcgtcttgaaacacataggaatgagtaaaagaaatagcccaactgcagagattggcaaacccaacatgttcattacatcagcattataaaaatatttccacacagctaaaaagttttaagactaccaggacaaaaatcacatgccagctttaatttcgaaaactgagaaatgcagagtgaaagaagcctaagactcaatccatctgagtgtcgagtatcttactgtctctcaccaactagaaggacttgttcaggagctgatgattgcttctcttttcccagaagctaatgccagtaagattccagagggcaggggaaaagcaacagtcactgaaatagagtataaaccaagtgattcaggagattatttataactgtttttaaaatgcatgttttcatctaaaatagctctagggaaactgatacaagcccagtcacaacacctagatctcaaaggccgttcaaatatcattatgagggcagcccaggtggtgcagcggtttagcgccacctgcagcccaggctgtgatcgtgggaactaggatcgagtcccatgtcgggctccctgcatggaacctgcttctccctctgcctgtgtctctgcctctctctctttctctctctctctctctgtctctgtctctatgaataaataaataaaatatttttaaaaacccacaaatatcaatatgaaaataggactgagcgttaggagacagcatagacagcctgtagctcaccactggatacatatcagtcacttcccctccgaatgaaggggattgccaatgcctcctcttgtgaaaagcagaaacctttcgttccaccaggtaagagcaaataaagcctgcaaacttcatcccaagcaccactactcagtcgtgtgaactaagaaggacgcacatttgctacaaactggtttatagataaatgtgttcctttaggtctttcaagttaaaacagggggaaacctacaaatgtaacttggaaaaaaaattgctcaaattagcaaagcatttgaagaaagttgtgaaaatgcatcttaaccttcattggtgctcagagacaaattcatgagcaagcgtaaacgggggggaataactgccttcgactagggttctgaatgggaaaattgatagtcttgcccttggaggatctttagcaatttctgcagaagtttttggtggtcataactggggtaagagggcattcagtgtgctgctaaatatcctacaattcacagaaaagcccttagatcaaagaattatccagcccaaagtgtcaataatgccaaggaataacactgccatagatcataaatctatgatgaaaacttttggcagattttttgtaaataaacaactggacttacactgcaaactttaaattaaaacattttcattacaaggcttttgacatttctattttactatttgaatataggctgagaatcagaatatggtaaagttgggtattgtcaagaaatgtgatctaatatgtatatatatcattgaatgttcaaaaacccatgtttcatttaattttctgaataaagtctaatgttaagatggaatggtgagtgataagtggtagcatgtgttgaggtgaataacaattctgaattccaaggtcactgttacaattactaccaaataaacttacaaattactatatgtcatgggtcattagaggtggggttttttttccagtaaaaaacctcaaatgttaaatactcaaaatgccaagtgaccacagtaataacctggtgagaataaatttattaagttcacaaaatttgaagtttatatatctgtattaattttaaaaatagatataattgattatatgttaacacatttttatagagagaaagcaaagtaaaataagaattctggaagacaggtgactttgtgtttacttctgtgacctgagaatctccttttattttcttgaaactctcctttccctcctctcatccctaacattttctcagctgtatcatcaccacatgacacacaagtgaggcccagagacacaagcacaacaacatgcatgacaaatgaataacatgagcctacttttctgagttgtaatctagtgccctcacccctcccactgcacagcaatactataaggatcacataagctatggcagactttgaaaaacatggagtggggtacaagtatctgatgaaagttggaaggtataatggcaagtagcagagtttcctgtgggggctgactgtccacatgctccacttcctcatcttagtcgacttccccaatttcccatggtcatcagctgccagggactcatcaagccactcacgtgtctcttctctccttcaggatgaaaccagaagctgctgggtcttctcagtgggtctcaggtgtacccttcatccatgcagaaggtgtccaaaaggaggtcagggtcctgagggtgctgactggcgtgagaactgagagacagccagatggtgtggaggtagcccccagtgacccctggctttgggtgaagggagactgtgctgtgtcacctaaactagcacaaacctagtcctggaggcccaccctgaacatgagattccaaaaagaatagcgtgttcacctcctactggctgtaatcctcagaaaagtgaaactccgacaagtggactttgactgggtttcgttatgagttcttcaggcttgcagatgaaattgtgacattaacactcctcaccaggcccagaaagccagggcactaacactgggcccaatttgacaactagtctgtgccatctccaactggccctcacacagcacctagtagtggtggtctgtcctcaaccttttctccacctcccacacatcaagggtccccccacctactgtttgcttctgaatgcagtttgctagggattagagttaaaagcaagactgaaaagcaaatgccccatctctgcttttactggtgagaaaacaggctaaagaaaggaattaccctccccaacatcatggcacccagctaaggtctcatatgtgcaagtttattgctctttttatcttgattctctattcctctttgctgagtcagatattgactctgagatactaagaaaacttaataagcttatcaaccagatgtttgggcacaaaaataataatgattaaaactacaggcacactttcttttttttttttttttttttggcatgtgtctttgtttaggttagattttcccttaaatttcccttaagtcaattttcttgaatcagagtgcaagtctccctgggttccgcagagatgttctcagggattcaagagttctccagaataatttaaaatttaacgttagatgttcatttcaatataaaatataagcatttgtgatattatgatgtgatatggtttgagtttattttttttcctgaagtgtcttcacttcacaatctgaatgataagcccatatttgggcacctaacttgaagttgctattcttaatgtaagatttttttcccttcatctttcaatgtaggtgaagacccttcccactgtggagaaagaggattttgaagaggagagaaaaataattaaacattgttgagcatctcctgactctctctctcaggtagatggggcaagtgctccactttacttctgattcctagaccggctgcagtgccacatacttcctctcccacaataacatgaaggcagcaaaggaaagtcacccaacgtaagaagaggtggaccttgtaaggctcaaatgctggagggaaagtttgcaacccaaaatgctggtgtggaatgatacagcaagaggatgttgtgaaaagaacatcagcaccaatgtgggaaggacagtgaccactaggaggcaagatgttaccaaggcatatagtgggagtcagtggtggaaatatgaggacagccttccacagcaaccctgcatcatccctaccttagaaataaccctaggcagagggatgtttttaaattattaattgttatgaatgccactgactttcctcagcaattactagcttaattcctctgccaaaaggcattatagcgcttgacataaaaattaggatcagtaataggaaaatacagaaaattttttacacttaactttgtggtgtgaaactattctacccattgcacatattccatatcatttcaattatataggatgctggaattctcccagaaatctttagtacctacctttgcattttatttatggtcagtcacagtagtagcaactgcccacttaaggaagctcatttaaatttttgtacatctcttctcaaaaagcccttacatatactttctcaaggtcttccagtttggaaataagaactctgtcctgaattatgctatgaattacaggtgtccggttttttgtagggacatgttgacacgtgggagaaaaaggcaggagatgctgcggagaccaggcaggccgaacaaggatctgagagaagacagaacagaagggaagaagaatcatgtatctactagatacatggtcactagagggcagcagagacacgctcaccatttggccttcactggcttttccccaagacttgattcactatttcctcctccaaatactgctatcatgcatgacacattcatgactccctcagacagtatgacaaaaggaatcttgagcttaggatatctgagattttaattctagttttgctatgaatttaggtaaactttactttgaataagtttatttgtagggctttaatttccttagctttaaaataaggataaggctaatatatgcactattcatattaaaatgttcctaaaaggtagtgtgagaatataatcatgacacaaaatttattttggtaaacctaaattttaggttatttggtaaacctatacctaaataggtaaatctatttaggtataggtttcagtaatgggagtgacattgtggagagaagggtgactaaaatagagtagataggaaatggcaagaaaagactaatgcaagaggagtcaggagccctgctaataatttggagaaattcaggtgatggccaaccattatacatatataacatcctctttatccattcatttgtcaatgaacatctgggctcttttcatgttttggctattgtgacattgctgctataaatattgaagtgcatgtgcccctccaaatcactatgtttgtatcctttggatacatacctaatagtgcaattgctgggtcatggggtagttctatttttaactttttgaggaacctccatactgtttcctagaatggctgcaccaagtctacattcctaccaacagtgtaagagggttccccgttctccgaatcctcacccacatctttcatttcctgagttgttcattttagtcattctgactgatgtgagatggtatctcattgtggttttgacttgtatttccctgatgttgagtgatgtggagcattttttcatgtgtctgttgactattggttggccttctttggaaaaatgttcatgtcttctgcccacttcctgattcaattttttttgggtttagggtattgagtttgataagttctttatagatattggatactaaccctttatctgatatgtcatttgtaagtatcttctcccattccataggctgcattttagttttgttgattgttacctttgcaatataagagctttttatccttatgaagtcccaatagttcatttttgcttttatttctcatgcctttggtgacgtgtctagcaagaagttgctgtggctgaggtagaagtgggtgctgctagcattcttctctaggatactgatggattcctgtctcacatttatgtcttcatatattttgagtttatttttgtctggtgtaagaaagtggcccagtttcatccttttgtatgtggctctccaattttcccaacaccatttgttgaagagattgtcttttttccagtggatattctttcctgctttgtcaaagattagttgaccatagaattgagagtccctttctggattctctattctgttctagtgatctatgtgtctgtttttgtgccagtacaatactatattgatgattacaactttgtactacagcttgaagtccagaattgtgatgcttccagcgttggtttctttttcaacattcctgtggctattcagggtcttttctggttccatacaaattttaggattgtttgttccagctctgtggaaaatgctgatgggtattttgatagggattgcattgaatgtgtagactgctttgggtagcaaagacattttaataatatttgttcttccaattcatgagcatgaaatgtttttccattgctttgtgtcttcctcaatttctttcctaagtgttctatagtcttcagaatacagatcctttacctcttttgttaggtttgttcctaggtattttatggttttcagtgtaattataaatgcgatcgattccttgatttccctttcctctgcttcattgttggtgtatagaaatgcaactgactactgtgcattaatattatatcctgcgactttgctgaatttcatctgttttagcaatttttttttttggcagagtcttttgggttttctttatagagtatcacatcattgcaaagagtgaaagtttgatttctttgctgagttggatgacttttgttgttgttgtctgattgctgaggctaggacttccagtgttattgaacaattgtagtgagagtggacatccctgttttgttccttactttaggagacaagctctcagtttttcccaatcaaggatgatattcgctatgggtctttcatgtatgtcttatgtcttaaggtctgttccctctatccctacacggtggagagtttttatcaaaaaataatgctgtattttgtcaaatactttttctgcatctactgagaggattatatggttcttgtcctttcttttgttaacgtggtgtatcacattgattgatttgcagatgttgaaccactcctgcagcccaggaataaatcccacttggtcgtgaataatccttttaatgtactgttggatttgaatagctagtgtcttggtgagaatttttgcatccatgttcatcagggatattggtcagtacttcttattggtggggtctttgtctggttttgggatcaaggtatgggcttggtatctggcctcatgcaatgggcttggaagttttccttccatttccattttttggaacagtttcagaggaatggtattaattcttctttaaatgtttggtagaatccgtctgggaagccatccagccttggacccttgtttattgggagatgtttgattactggttcaatttcttttctggttatgtgtctctccagcttttctatttcttcttgtttcagttttggtagtttatatgtttctaggaatttattcactccttccagaattgtatttcttcagggttgtttgtgatctctcttatttcgttcacaactttatttattaacttcctttctttttgataagtctggctaagggtttatcaatctcattaattctttcaaaaaacccactcctagttttgttgatctgttgatctctttgttgatctgatatagaaattaaatttctatatcgatttctgctctaatctttattatttctcttctcatactgaattgagactatatttgctgttctttttctagttcctttagatgcaaggttaggttatgtactggagacttttcttgcttcttgaggaaggcctgtattgctatatacttccctcttaggcccacctttgctgcatcccaaaggttttgaactgctgtgttttcatttttatttgagaagtcagttaaattttttaaaaaggcaatagaacttctgcagagtggtacttgaaatacccaaacatctaggcatggggaactgagctatatcctggttctgacagacctacagtctgaaaggaagaggtctttgtactatcagatccacactgtctcagaatccaaaacctatgtgacaatcccattcctctcaaattaaaaaaaaaaaaaatagtgtatttttaaaattaaatttttacttattttacttttaaatttacttttatgaaaaaactataaaagtttaaaaacaatcactaatatcaaccatgattttttgaaaatggcaaaattaaaataaatgaattccactgtgggtgcctgtaggagtcaaatcctgagaagagatataagcaccaatgaagctcgcactagttgactagcaaaccagcattgatgcctcacttggggaattagaaaaattgcaaatgctgttaatgcctttccattcttcctaggacccgagagagtgcactcacagagatagttaggcatgtcttgcactggaaagaggagaatcttctgaatgctaagagaaagagtgttaagagaagcacatcatcctaccgaaccccttgcatttgcacctgcttgccctgccaaacttctaggttcttgccctgccaaacttctatactcattttccactctctacaccacatccaagagggttactgtagttcctcatgtggccagtagatgacaggcttgtccactgagttttaagtaggcaccatgccttcagactgagttgtatcctaaaacgtcccagattttaactttcaacctcttcttttcataaattgtggagaatggggcaagtataggaaaattactgcggtccagtatgcttcggtctcctcaggaccttagcagaataggtgactgaaccacttggagatgaggatgggaatcatgaagaaacatctctgtaagcaaagattagcaatggagggaaatccaagaatagttggagaaattagacagctctccatagtaagagatattttcctccagtgttcaggtacactttttttctggaaccagttctagcttctgacttctgttgcagcttctgctgctccagttaccagtagctgcaaagcctggctttaaagtcctctatttgaagacctctctgtttcacctcccttccctcattggttacttttaacaggtgcactgtgctgcattgtgtggctgtactccatttgttcaaccagtcacttttaaagagcatctggattttgttttcagtcttttcttattgtacataattttgcacgaatagctccagatgggccttgggcaactttcactgtggtagcctgagaagcaataaaacaaattaaggaagaagcatggcagaaacctttaagaaagtattggagccccctttgagccctggcatgtaccctagcacattggagccaaacttaggtctaatttttttgttgttgttgtcaaaatgcatttaattttcaaaagtcagcatacaattaactttaaatcatgttgaaatacaaaaaaaagccattttttaaaatggatttatggactgaatttctgcaccagtattgctctaacttgccaaagccattcaccttaagatttgctgagcatgtgggtagtgccacttttcttctcagattttcaagtgtgagagatccctctagaacttggatactatccaaagaacaggcctctcagggaaatgcaccacaaggtaccaaatccttcacaaaagaaagaaagaatgtatatctgagtctcctacctcttctccagtgtctcttgcactgtggtactggacctctggtgacacccatccttaaaatttcagatttgagttctgaatagcctgggtagagatgggagccatcagcaaacctatcacctcccctccatcctaatcttgccaccagccacagcacattcatcctgaaaccttatcttcacaccttcattagatgggagccagcataaagcagatactctgactctgcagtttgattaagtacctgcttatcactttgggtttccttttggtctccagacacacgtacaaagctctgcataagtggtttctagctgctggccgtgaccatccattgctttgctgtctcatctatggcaaaatatagtgctgtagatggatatgttgacttattttcccacacatgacatcaatttcacagaaaactgacagaaattctacccaactgcaacaagaaaggagtgccacagtgtcatcatccagtgcctgattatttaatgatgtgctggttgtttagtgagtacacttgtgcatgatccttgtgtggcatgatacagtagaaatcaatggaacatgcctccactattcatgtggggtcaaccaacaatgattcctgatgctactgaagctcctactcaagactatatcctccaaatgatggataatacatgccaaagggttaatgtggtaacccttctctcacttttgcatggaagactccctgctcactgtatcccccacctctttccccagaatctcagggatagactcagagcccaagtgaggatcaagctatgtaagggatggaggtaccttttgcccatatcttgcttgctgaggtcaagagggccctttagggaaacttacagctttgtactagggtaagaggctacagcagctcatctccctggcactgggcatcaaaacattgcagacaggatagcaccagaagaacaggtgctatgaacacttacagagtaaagataatcaatgtttcttgcaatccacatatattgaaaacctcaattatccagccagataggagcaaagcaaagtggtaggatttcttgattccaaaagtaacattgatagccagtaggagtgactttcagcagagaaataaaattcattaaagaatttaaagactagaaacatcaccctaagaacattcaaacactgatttttaaaactagttcatttattctttcttttttcttctttctttcgttttactttcttttgttatattgtgtgatagagattgagataaatcaaaagaaatgcaaatattaaatgtcacatggaagttaaactcattgcttattggacttaattatgaacatatgaggaaactacccacccctaaacttacttccactttgatcatacaccaaatggtggtgatgagacttggcttgggctatgatctcactacaggagagtgaagaaaaagtggtcaaagcaaggagaaacattagtaaaccctttatttgtataaatgtggaaatagacattttagggagacttttgataacactgacaatcaagatagtgagacaagtagctatttgaaagtaatgacagagccaatccattcagagagagcacaggagaagtttagagctggagacagacttgggtgtcacagtacttgcaactcctccactaagggcagcaagggacttcttataccactggcctcagatgttactaattttcttttattagtgcttgcaaggggaaataatttggatggttgaaatcactgaaggatggcaggatggggatttacagcttgaacaaaagtcatatccctccagccgacatgaccatcatagctctgtagcccctgagcttagattctgagcaccgttccctgcacataatgattgcctgagaggggatgcttctggaactgagaactgcccagtgagtatctcttaatatccgagtatagaaacaaatactggagaaaaagtttccgttaggattagatggtgacatagaaaatgacatttactgtttgttgaagcaataaatagattttgggaaagccctgaagtaaatcaggcatttctgctctagaaatatgagagtaacatggtcatttctgagacctcttccagttccccttcagtcaaaacacttctaacttgtttaagatcagtctttcccccctgtttagctgaaattttctgtttgttccataccctacttcatgcctccacccctccccctctctttcctgttccttctgatactaaggcaatttaaggatgattctctcttccataggcctaagaactttacttcacagtctgcactatccatttttggccattttaattctctgctggccagttgaggtcagggagagtagcctgtagacaatccccagatgtgacccacgtgttgatctatgcacagttggtgccatccccaggctgccatgcataagtccatgacaagagtcagctgctggatctgagccctgcctggaaagtgagctataaacttttcttttctgtagaaaaattttccattccatgatgacaaacaaatttgtatggttgagttttaattatagttacaaaaattcatcctgtgtgaattgtgtcatccacagtattttctatctgctatttatttataggtagtgaatgaaagagatggaggttttagaaaaaggaggttatgaaataaagaggtcaccaacctctagagggaatattcactttttatagcaagttgttctgaatttaggctggctgcttccctttttcttcccactctgaattgatgggtattgttttcactgactagtttctaggcatcatgtatatcccccctggcttccgaaatgctcatctggacaagacttttaattttaaaaaatgaagcaggtataaaaaagaatgtatgaagtgaaagaaagaagggatgtagagaggaaggaaagtggaaaggaaagaaggaaggaaggaagaaaggaagggaagaaggagggaaggaagaaaggatggaaggaagaaaaggaaggaaggaagaaggaaaggaggggaaggagggaggaagggaggaaaagtaaaaggagtcaaaaggagaacaaaagggaatggggaacaaaataaaacaattctcatgtttaataatttccaaaaaattcttacaatggggcctattttatacacaatataaaattataccagttccttgtagatacccagttctatggtcaaaaataatatcattcatatctgctcaccaggtgaatgtgtcctttaccttttgttgcctgatcatttgccatcttccacatcctagctatctgatcaaggatggattgtgcagtatgaccctcttataatagagataccacaagcacaaagcctcaccaaatttgttggagatcatgattatacagatttattggcccagatgatggcccagtgccagcaatgaagctaaggccactgggtttgtctcactattcaggttataaaggctggttaattaaaccaaattaattggaaattttgcagattgaaatgatagttctaggacccactagtggaactgtgtgggtctcagacataggaaacgaagcacctagtgcatgccagccacattggaaagtgaacttcatataagaaccttgggatttagcagctgctctcagcagaggagggccaggccctgataactccttcaaggaagaggtaaaggagctcttgctccaaaggagatttaccttgccctcactcagtatccacattgctcaccctgaaggaggcccccacaggctactgaaatgcaagtacactctttggtcatggttattactcttattgtgtagtgcaggataataagattgctagtagatcccttgggccacagactgtcttaggagatgtgctagaacaaattcagccagggacacaactgcaccacaggatgactgagcaccaggcactcatgggctcggttagaaagatctcggccagtatgccactggtcatgaattctggccaagagttgacctccctctacattaaatggttcaacagaattgatgctcaaatgaatcactttgtctttataccaatctcaaattagatcccacacagaaaggctctcccaatgtgaccagatcagatccatctggctggttggtttgtgctctaatgttcttactatgattttaatgagtaatgtctggatcatgaagctagtatccatagatgtctctgcaattagtctattagtggttcacaatctatatgcattattagtggagtccccacaaagcttggttatggacactatgtactcgtttgcaaggtgcactcctcatgatctgatggagctcactgagactgctcacctagtggtataccctatacttgtagttccaacctgagacatgcctctagcacacatactaagaattaaacaccagccagacactcatattcttcattgatctcttcatggaaaggccactatccctaggttggccttcaccaccccaaatacaccaggtccacattagcctgagagcttactgttagagatgattttacctcagatggtgacaccacaacccaagagaacaacaaagaagacaacatgacccaacctcatgggacattgggattttttcccctaaggttgtccagattgtctccaggaaggaaaggactgtattgattttcaacctggatgctgattggcaaacatacctccaaatgattgacaaggaggaccctagagagcactatttgttgttgttgtttttccaaaagagctaaacatttgcctcagaaagctaacctttagcaaaatgcttataaaccataagtctcctaccatctgtctggcaggactagagatcatttcaccctgatggcaatgaagccaaacaatgtattttaaaccacattagttatgtaagtacttcttcataacacccctagcttgatctactcaatttcatgatcagtgacctctccatgctgttttcactgctcaatgtactagttacagctttgcttttcacctaacacctccacaacatactccactcctctttttgtttccaccaccacctcctctatacctgaaattgtcactgcgtttctctctacatcttatccataagccccttccaacacaatccaagtgggccacagccaacttgacaaatatattcatacaaacccccaagatagcagcccaggccttgaaagtaaaacaatgctagggctatcacaacaaggggactgacttacagccatgtgtcattatgctgcagctcttcctagtgatgagccttttgtgttaattcccttcaacaccatgagtctcatttagactagacaaacacctaacctagactccaaacatggcacctggagctctgcttaacaagtattaacttgatggattccatgacagtccattttctctctgttgttcagattggttgatttctgttgttcagtctccaaattcactgatactttcttatcttcacctagctgtttaaaccattcagtgagattttcatttttaatcattaaattcaaaattttccatttggtctctgtatcttctaattctttgcttgactttctagttttaccaatttttaaaattttaaaatttttaaaaattactaatccaaagatttttgtgatgatagctttaaaatctttgtaaaatgattttgacacacatgtcatcttagcattgctgtctgttgattgtcttttcctatttttgttaagatatgtctggttcttgacatgatgaatgctttttttttttaacatgtcttggacatttcgattattttaaaatactctggatcttatttaaatctccttttacccagactccccagatattaggccaggaggagaagggataccatctcattactggcagataggtgtgaaattccaggttctccatttggctccaatgactcctgagatggtaggagtgactttgtgacatcatggttggtgtaaaaattcagactctccgggatccctgggtggctcagtggtttagcgcctgcctttggcccagggcatgatcctggagtcctgagatggagttccacgtcaggctcgtggcatggagcctgcttctccctcctcctgtgtctctgcctctctctctttctctctctctctgtgtatcataaataaataaataaataaataaataaataaataaataaatcttaaaaaaaaaattcagactccccatgaggcctctgcttatactacccagactggcagatgaggagcatcttgtaagggtagtggtaaaagtatgagatttccacttggcttcttgtgacaataacctggcagagaaggcaagggctgcctcgttaccactgggttgggtagaagtccaggccccctatagagacttcactaatgccacagtgtggaggtggcctattactgatagagcagtggtgaaagtcctggatcctgagtaggcttcctctggaacagtcctaatgggtttagagggtgcctttctatggccagggtgggtggtagtctaggctccccactcagcctttgctacctgaaatgggagtggagggaggggacacagatttttctgtagtagagtagtatgattatgcctacatgttctgccttgctaggctgccctttcctgtgtttttgaggtagaaaaagatcatttccttaggatatttttgtctgtgcctactggtgtttcttagtttccagtttctccaacacttcttcctgaatacattaggcaaaaaaggaaaatccaaggaactcaccatatgtcattcctcagtcccagggactggagtgaatctgccttcttttctccacctttcagagtctccttttgcttgtctttacctgtacttaatttaaaaatgggaagaattgttatctactccatcttgtcctaaaaccaaaaatccctcaccataaaattttgatatcttaaaacatagatcaaaattctgtgcacttatacctagataattatgatatgtttatttaatttgaattgtttagtaacaaaaataaagctaaaataaaatagcaggtgtgagattaattatgtaatagcaaactatgaaaatatgcatattttttcaaaaagatcacaggaaattatatatatatttatttatatttatatatatttataacacaacttatatattatatatatacattttccatggatgccatgtcacatacacacatgtgtataaaaaataaactcaaaactatctattatcaagactcagggatcttcttacactgactattcagatctcattattatcctagactatgcttggctctcagattcactcagtagaatgacaggaatcaaagcatgctaaggggacagcatcagatgtttctcttcagtgggaaatttattgaaaaagtccataatacagtccaggtgctagtctctgcccaacccaccccgaagttacagtttaggtgcaaggagacgaatttacacctatgagagtggagtctgccctggctgagcatcttcatctgccttggagccagtacttctaataacacctccatggacataactttcagtccccctgcaaggacatggcatgcccaatacaagggtctctgcattcagtgatgctcaaattgtgagctcccaccatttgctataattaaccacattttcctcccaggcaagaccataggcaagtttgtctataaattcagctgacattcattctttatcagatttccagaaaatagctacaaaactagcctgagattaaatttgtcatggagaagtttttaacatatacccacaagaatcaatgtgatttacagttaactttttcttttttagacatcatttcatttttcaaattatttaaaagaagcacattccatattttgtatgcttattttttaaaaagacatggtaaaaattagtataaacagattttaaatgtttttattttttatttttatttttatttttaataaatttattttttattggtgttcaatttgccaacttacagaataacacccagtgctcatcccgttaagtgcccccctcagtgcccgtcacccattcacccccacccccccgccatcctctccttccaccacccctagttcgtttcccagagttagcagtctttacgttctgtctccctttctgatatctcacacacttcttctcccttcccttatattccctttcactattatttatatttatattccccaaatgaatgagaacatataatgtttgtccttctccgattgacttacttaactcagcataataccctccagttccatccacgttgaagcaaatggtgggtatttgtcatttctaatggctgagtaatattccattgtacacataaaccacatcttctttatccattcatctttcgatggacaccaaggctccttccacagtttggctattgtggacattgctgctagaaacatcggggtgcaggtgtcccggcgtttcattgcatctgtatctttggggtaaatccccaacagtgcagttgctgggtcgtagggcaggtctatttttaactctttgaggaacctccacacagttttccagagtggctgcaccagttcacattcccaaccaacagtgcaagagggttcccctttctccacatcctccccaacatttgtggtttcctgccttgttaattgtccccattctcactggtgtgaagtggtatctcattgtggttttgatttgtatttccctgatggccagtgatgcagagcattttctcatgtgcatgttggccatgtcaatgtcttcctctgtgagatttctgttcatgtcttttgcccatttcatgattgggttgtttgtttctttggtgttgagtttaataagttctttatagatcttggaaactagccctttatctgatacctcatttgcaaatatcttctcccattctgtaggttgtcttttagttttgttgactgtatcctttgctgtgtaaaagcttcttatcttgatgaagtcccaatagttcatttttgcttttgtttcttttgacttcgtggatgtatcttgcaagagttactgtggctgagttcaaaaagggtgttgccagtgttctcctctaggattttgatggaatcttgtctcacattaagatcttacatccattttgagtttatctttgtgtatggtgaaagagagtggtctagtttcattcttctgcatgtggatgcccaattttcccagcaccatctattgaagagactgtctttcttccaatggatagtctttcctcctttatcgaatattagttgaccataaagttcagagtccacttttgggttctctattctgttccattgatctatgtgtctgtttttgtgccggtaccacactgtcttgatgaccacagctttgtagtacaacctgaaatctggcattgtgatgcccccagctatggttttcttttttaaaattcccctggctattcggagtcttttctgattccacacaaatcttaaaataattttgttctaactctctgaagaaagtccatggtattttgatagggattgcattaaacgtgtatattgccctgggtaacattgacattttcacaatattaatgctgccaatccatgagcatggaatatttttccatctctttgtgtcttcctcaatttctttcagaagtgttctatagtttttagggtatagatcctttacctatttggttaggtttattcctaggaatcttatgcttttgggtgcaattgtaaatgggattgactccttaatttctctttcttcagtctcattgttagtgtatagaatgccactgatttctgggcattgattttgtatcctgctacgctaccaaattgctgtatgagttctagcaatcttggggtggaggcttttgggttttctatgtagagtatcatgtcatcggcgaagagggagagtttgacttcttctttgccaatttgaatgcctttaatgtctttttgttgtctgattgctgaggctaggacttctagtactatgtggaatagcagtggtgagagtggacatccctgtcttgttcctgatcttaggggaaaggctcccagtgcttctccattgagaatgatatttgctgtgggcttttcgtagatggcttttaagatgtcgaggaatgttccctctatccctgcgctctgaagagttttgatcaggaatggatgctgtattttgtcaaatgctttctctgcatctaatgaggggatcatatggttcttggtttttctcttgctgatatgatgaatcacattgattgttttacgagtgttgaaccagccttgtgtcccggggataaatcctacttggtcatggtgaataattttcttaatgtactgttggatcctattggctggtatcttgttgagaattttggcatccatgttcatcaggaatattggtctgtaattctcctttttggtggggtctttatctggttttggaattaaggtaatgctggcctcatagaacgagtttggaagtactccatctctttctatctttccaaacagctttagtagaataggtacggtttcttctttattttttattttttatttttttaaagatttatttatttattcatgatagacatagagagagagaaagaggcagagacacaggaggagggagaagcaggctccatgcaccgggagcctgacgtgggattcgatcccgggtctccaggatcgcgccctgggccaaaggcaggcgccaaaccgctgcgccacccagggatccccggtttcttctttaaacgtttgatagaattcccctgggaagccatctggccctggacttttgtgtcttgggaggtttttgatgactgcttcaatttcctccctggttattggcctgttcaggttttctatttcttcctgttccagttttggtagtttgtggctttccaggaatgcgtccatttcttctagattgcctaatttattggcgtatagctgttcataatatgtttttaaaatcgtttgtatttccttggtgtcggtagtgatctctcctttctcattcatgattttattaatttgagtcttctctctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgatatttgctgttttttctctatctcctttatgtgtaaggttagcttttgtatttgagttctttccagtttttgaatggatgcttgaattgcgatatatttcccccttaggactgcttttgctgcatcccaaagattttgaacggttgtatcttcattctcattagtttccatgaatctttttaattcttccttaatttcctggttgaccctttcatcttttagcaggatggtccttaacctccacgtgtttgaggtccttccaaacttcttgttgtgatttagttgtaatttcaaggcattatggtctgagaatatgcaggggacgatcccaatcttttggtatcggttcagacccgatttgtgacccagtatgtggtctattctggagaaagttccatgtgcacttgagaagaatgtattcagttgagtttggatgtaaagttctgtagatacctgtgaaatccatctggtccagtgtatcatttaaagctctcgtttctttggagatgtgcttagaagacctatcgagtatagaaagagctagattgaagtcaccaagtataagtgtattattatctaaatatttcttcagtttggttattaattgattgatatatttgccagctcccacattcggagcatatatattgaggattgttaagtcctcttgttggatagatcctttaagtatgatatagtgtccctcttcatctctcactacagtcttcggggtaaattttagtttatctgatataaggatggctacccctgctttcttttgaggaccatttgaatggtaaatggttctccaaccttttattttcaggctgtaggtgtccttctgtctaaaatgagtctcttgtagacagcaaatagatgggtcctgcttttttatccagtctgaaaccctgcgccttttgatggggtcattaagcccgttcacgttcagagttactatcgaaagatatgagtttagtgtcaccatgatatctattcagtccttgtttttgtgcattgttccactgaacttcttcttaaaggggacttttaagagtcccccttaaaatttcttgcagagctggtttggaggtcacatattctttcagttcctgcctgtcttgtaagttctttatctctccttccattttgaatgagagtcttgctggataaagtattcttggttgcatgttcttctcatttaggaccctgaatatatcctgccagccctttctggcctgccaggtctctgtggagaggtctgctgttaccctaatattcctccccataaaagtcagggatttcttgtctcttgctgctttaaggaatttatctttggaattatctttatctttggaatttgcaagcttcactattaaatgtcgaggtgttgaacggtttttattgattttagggggggatctctcgatttcctcgatctgaatgcctgtttccctttccagattaggaaagttttcagctaggatttgttcaaatacatattctggccctctggccctttcggcgccctcgggaaccccaattaaaagtaggtttttcttcctcaggctgtcgtttatttcccttaatctgtcttcatcgtcttttaattgtctgtctcttttttcctcagtttccctctttgccatcaacttgtcttctaggtcactcactggttcttccacctcgttaaccctcgtcgttaggacttctagtttggattgcatctcattcaattgatttttaatttctgcctgattggatctaaattctgcagtcatgaagtctcttgagtcctttatgcttttttctagagccaccagtagctgtataatagtgcttctgaattggctttctgacattgaattgtaatccagattttgtaactctgtggaagagaggactgtttctgattctttcttttgaggtgaggttttccttctagtcattttgcttagtgcagagtggccaaaagcaagttgtattgggaaaaggagaaaaaggagagatagaaggaaagaaaagagaaaaagaaaaaagaaagaaagaagaaaaaaggaaaaagagaagaaaacgagaaagaaaaagaaagaaagggaaaaaagggagggggaagcaaagaaatcaaaaagcaaaaacaaacaaacacgggggagtatcttctgattctgtatatttaagtcccttgacttcccctggaacttgtcggtctagctggtcttctgggggaggggcctgttgtgctgattttcaggtgtgagcacttgggggagctgctctgcccctgcctggtgcagggctcagtgggggttgttcaccccatgaggccacaggaggaacaaccgcagtggcggggccagctctggagccctggagtcagctcccgcagtaactactgagctccccgtctgcagggcctggaggctccggggcagggccgctgctctgctcagctcggggcaggagcgtcctcgctgtcctgggccctcccggcctctgcctgtcccggggggaggccggatcctgggctgtgtccgggcgccctgtgctcccggggcctgcactgttggattcgcgctcccgggctgcgcaaccctctccgcggagccgccgcccgagcccccccgagctgctcctggaaccatgcagccccctacgcggagcctcttcctctgcccgagctccccgagctgctcccgggccgtgcagccccctccgcggagcctcgtcctctgcccgagcccgtccgagcggctccgggtcccccgtgagcgctgcagccgttagggagctcggcgcactctcccggggcgcaggtgtctgttagtgtccccgggagcccgagggcatccccgccctcctgggtcctgctccacctccccgtgggcccatttccgccagggaaggttggtgcagctcctgcttctccgggagggggctctcctgtcctggggacactcgccccggcctcagccgggctcctcgcggggcccctcccccttggaggcttttgtttctttattcctttttccccgcgtcttcctaccttgatagaagcgcgaactcttctcactgtagcattccagctggtctctctttaaatctcaggccgaattcgtagattttcaggatgatttgaaggtgatctaggtaatttggtggggacgggtgacttggggaccctactcttccgccatcgtgcccctcctccccttaaatgtttttaaattgtatttaagcaatctaattagattaaacacactcgggaagtgtacatgaggaataaactaaagcatcccaaatctttgacctttcaaaaactgcctgaatactcaatgccaacatttatgaagaattacatgctattgaccacaagagggaagccttgtaccatttttaccagggattagaaaagcgggggaaagagaaacttttttcctgagaaacttttaaaatattcatccgtaagtacagtgtacaggagaaaacaatagtcatcccctttcgagactgcattggtggttgaagtggctttagtattttgaatacacttgttcttggctccacatgttactggctacacaattagagacttgatatattttttttgcacatttaatttttatctttaattaatccatttttaggagacatatcactgtggaatgtgtactttggatccaaccaaatcctgggttcaataccactgtgtttacttcctaagtgggacttttctttagaacccaggtttctcagagtaaattggaaataaaattattatctagtgaataaaatagtaaggtttaacatgatagctatttttagtagtattttcaattaataaggaaatacttatttcagtaaaatcatgaagaatcctctggcctggatctctcctttcttttaccttaaaaatttcaaagttcaaaagtaatctcagaaatacaaaatataagttcttcactatcatccctcttagtttttctaaaagcttattcagcattaaccacctctcatgtattaccctatttaactcttaaaatgatatgttcttgagatgccattcatccactctagctctcccatcctattatgttcactaacatttcccattgttctccatgctggacccgtggcacattcagcgcaaacagaagccacctccttcgcatgacatctatttttgtataaaaaaatttccttcattgggcagcccgggtggctcagtggtttagtaccgcctttggcctggggtatgatcctggagacccgggatcgagtccacgtcaggctccctgcatggagcctgcttctccctctgcctgtgtctctgcctctctctctctctctctatgtgtctctatgaataaataaataaaatcttttaaaaaaatttccttcattcattcacaatatttagacttgaaacttttgttccaagttggtttttggtgggttttttttttttttgtcatttttgttgttttttggtgttttgttttgttttgttttgttttgtcatttttctatcaccttcccctaaaccagtccatcaaggggcctaatgattcactcttcatatttcttaacatctcatcttcacactctctgccctcttaaattctctgtgagtgttttgcatgtttagaacccagctccttggctacaattgctgaccaaattcattaataaaacatcttcaagaattaattgttaaccaaaaattatataaatgtgattgaatgaaaatggagacttttccagctctccttaccccaaacacacacatctacattctataaaatcattcagacctagatgagattctacattttcaatgtcatgcaatagagcataatatttaagaataccatttcttgactctctcttacatggacagtggagtcaggtcacttcctattcccaggagaatagctgaaaagaggattcacaggtgagggcggcacattttcaggacaaaatggaaacaaccttgcgttgcaaaacaatgcaaaacagcatttcattgcaaatagaatgccctgtatttctgggatttgtgctggatttgtaacagcacagatgatatgtggagttgtaggtgactctgaaaacaagctgccagaatgtgtaaaatacaggagctggtactaagtgagtgagtcaaacgatttattggcaatatgggggcagcttttggaggcaaccagtcttaggcttctgtagtgatttttcaacctaatctgtcccttcacaatctctcagttattgaattcagcttgtgccttttagaacccacaaaaaaacttgggaattataaaacaacctgactatagatgttcaaatcataacaacagaacctgtggttggctttcagggaaatattctgaaatgtggattccaaattactaatttccccccgccccaacacacacatatacacacatgtacacttgtggccttaggttctgtgtgaaagttatctcatttccaagccataacctattacccctaaataccctctggttctaggtttggtactgtgggaggaacaagagagaggtatacatatttgcatttaataatttcaaaaattcccattagcttttatgtgtcatctgtatcacaggaaataaaagtaagagtattacatttcccaggctctcttgcccaggatctggatgtggccaacaggctgtcagtgaaagttagtattatgagatttggaaggtgacaagtaggttgaagccatctgatgcagtggacacaagggcttcacggacaggactcttgggaacagccttgtattgccaagactttcctttccctggagctgtagaggagctgtgatgtccgcagcagcttcccataggttcctgatcttggagttaggagtctgcactgacctttgctctttcaggcttcctaaacactttaaagttataattccctctaatacagaagaattgtaacaaacaattctatttagagtgtcttacaaggccttctattttcagactgaactatgactagtacagtagctcctcccaccatttgatgtcacttttcatacctcactgaggtgccttcagaaatcccctcagacataggaagctagaatatgggaaaagaacaggagaccatgggtagtgtccagatagaaacttctctcctagcatggagaaagggaactgaaagtattttctaaagtctcccaaatttggtaatctcatgagaagaaccaatcagtattttaaattaagccatatcataagttgctgagcaacaccttaggttgaagttgctgttatgacaagtaaaacatttttctgtaaagtgtctctgagtttaccatatactcattgagctgcttataagaaccagtcagtatgatagctagcaaagggcaggcatacagacattatacttgttttttcctctgagagaggagatgacaagcctaaatcataggaccagactctcagcggagattgatactataaagctctcatctggcccattcctttgcatccagaaagtgtattccttaacaatcttagggcaaaactgtgctgtgagtctcttccacatgatctagaagtcaatgtgagagggtgttcaaagtccttagatccgatcaaataatcggtaatgtgtagggaaaaaacctcatgatttgtgacggtggctgtggagcaggataatatctcagcacaacagtatagaaaatccaccaggagcatatgtgtcatgactgatattaaacagcaaactcaccatctgaggagctgcctcactgtcagggctctctcccttcattggaagtattcagattccaagcctttctacatgtggtttaattttcctttatattgtactgtatggtcagaaacatgaaggtcagaatgatttaactttcagttttttcagtggtgaatatcaaaacaaattcttgggatcagaacttcaataatttatgacatgaagagagctttcagaatgttattacctgagggacgttacgggaaagctctcctgcaggttattatctctatttctcccagtagaataagctctgccatatttattccaccctattcattgatctaagttcctcaaatgaggagtgtccccagcagtctaccgcaatgtttgatcatatttaagatggtagagattacagtccactgtttcttatagccactatctatggtgtgtctaccatccctctctagctaggggaatgttgacactcagagtttctcttctgatattctctcaatatcgtacagtgccagggatgcctagctgagttgggctgagttggccatctgggagtctagagtactgaaggagaatcctgaagcaaaaagctcctgaagttacttaagtgaagctctgtcacccactactgccaagaatcaggcattctccatagcatgacaacctaccttctttctcagatgctttgttgtcccttaaacaaactccccagctgtcacagcacagaagaataatctttcactaactgccatgtagggtgtttccattgattttattctcactaatgtgcttcaagtacatccctttctagaacttggattaggaagaaacagtctatgggtgaatgtgattcttgaacatttgtttattttgctatttttatttgattatatgtatgaggtgttttttctttttcttttcttttcttttcttttcttttctttttctttctttttttttttttttttttttttttttttattaagagctttacttgtttacctgaccctttgacaagagctcttcccttagcaacagatgtatcatctcaaaagtttttctgattggcttcagctcaacttatttaaatttcaatcagtcaaactctatcataccatacattctctctttttttttaaatccgtgtcagttataccctactctttagctctactgacctcccaacaaatcacagaagaaaatgaccataagtggagtcccagtgctaggatttttcatcatggctttcctgatgggtcctcaggaatcatgggctgtcaaaggtaagtgctgagagaaacaaaacttgggatagaaattctgagagcattggagagataaattgtaaatatttgcaagactgtctttgaagtgaaggaaaagtgtggcaggcatcgtgtggtctaaatctgaaagtattaaaaaattgtagtttggaggagttctgatcttataaattgaagtcagtcacatttagttgagaggaacaaaaaatggtatggattagtaccattgactttgagataaggctgacttgaagtgaaaatcttttctgagaggtattaacaagctatcctctgggctttaatttctttttctggaaaattagtagattttgaaatctcacatcattttgtggggattaaatgagaaaaaatatgagaagttcttgcaactgtttcttagacaaatatatgatattttttttggcaagtgaatcctgtcagaatattttaagcacagatattgcattgaagatcaccagaaaaggaagttaccaaaagcaacaatctacccaaggaagagcaagggcaggtatgcttataccaattgctcttaatttacttcctcttaggagaaggatggcgccttcaccacttcagtggatctatgatctatgatcacagctacttagtgattttctcaaaagagtagaacaatgaaaaaagatatggaaattcttttattattctctgccatctgcaaagcaaatgtttactgctatgaagatgtattgtgaaaaagtaacctttacccagactaaaccccagaaaggatggcagtacgctggaaataagtaatataatcatccagttccaagacccatgatagaaactgtatgtttctattgccttgaaagggccacaaatggagatgcatatgtgataaaatagaggctcttcccttgggatggaagaggaagctagaggtgtctctgttccttaagtataaagcagttttgaacctaaaatgcttgttataagcctgttgatgtactaagaaattacttacctcatctaattctttttattactatttttttttttttttttgagagagtatgtgattgcacaaaccgggtggggagagacaaagagagaaagagggaaagaatcttaggcagtctccatactcagcgcagatcccaatttggggctcgatctcagtaccctgagattatgacctgagccgaaaccaacagtcagataacttaactgactaagccacacgggcgcctctcatttaattctaaggacaaattcaagttagaagcaaaaccataagagaatataataggaaaactgcaaagaagtagataaaataatccatttaaaccactagataagtaaatacctgaataagaattaaagatttaattagatccagagttcagaacctagactcttatttatttatttttaaagattttatttatctattcttgagagacagggagagagaacagagatataggtagacggagaagcatgctccctctggggagcctgatgtgggactcaatcccaagactccaggatcatgacctgagctgaaggcagatgctcagtcactgagccacccaagtgtccttttaaacagtgtttccctcttcttaataatccagtgctctgagagaggccctagaactcttgtttaattgtatttaatgcctgggaaaatacagtgagtgattctattttaggaattgctgctagatttccaaaaagggaatcatttctcagctactagcatggaacctaacagcagcttcacaagaatctaggattttcagccttcatttccttcaatgcaccctacctctgcccttcatttctcccctcctagttctgttcaacatggatgtcctgcacctgagcctcatcttccagctcatttctgctctctatcattcctccattccacatggccaatcccttccactgcccacacccacatgtttgtctcacatcctgggttctacttcttctcctgctcctggtttccaccctaactctcttccctgccttttcagaggagcacgtaatcatccaggctgagttctatctgacccctgacccatcaggcgagttcatgtttgacttcgatggtgatgagattttccacgtggatatggaaaagaaggagacggtgtggcgccttgaagaatttggacgttttgccagctttgaggcccagggtgccttggccaacatagctgtggacaaagctaaccttgacacaatgataaagcgctccaaccacaccccgaacaccaatggtacgtgctgcactcctagacatggggatcataactttgaaatagatgcttcagcttatgtgttacattattgtgactgactttccctcccaggggcctagtgtggccataaacaagtccctacttctcatgccacaggcccaagaatttcatatgagtttgttcctttcctgatgtgctcatatctcatccttaccatccacagtcacttatagagccattgccccaaatctatgctggggagggtgggcaggaatgaaattatctccagtgcctaaaatatcctgtatatcttacaccacagcactggttccagttcatggaggagagtatcagagataggtatctgagactgtagtacagatcctcagggcagagtttcaactgcttattctgtttcagtgggagggagaaggactagcccaagcagggaaggctaatttctgtcctgtgtcctcagtacctccagaggtgactgtgctctcaaacacccctgtggaactgggagagcccaacatcctcatctgtttcatcgacaagttctccccaccagtgatcaatgtcacgtggcttcgaaatggaaaccctgtcaccacaggagtgtcagagacaatctttttgcccagagaagaccaccttttccgcaaattccactatctccccttcctgccctcagccgaggacgtttatgactgcaaggtggagcactggggtttggatgaacctcttctcaagcactggggtatggaccatccttccatctcctttcttttatgattttccccggtgatgcatatgtctggtgctttgggatgttccctaactcatccataacaattgctatgactcctattccttgtcttctcccattattcagtttcacccaccttttaatatgcatttccttcatacatcattctgtcttcctcttatttaattgattgataattatttttttgactgaataccctacctttgattctaattgctacgccatacacagtcattacctctgtactgtactctgttttattttccccagagtttgaaccaccaacccccctcccagagacaacagagaatgtggtgtgtgccctgggcctgatcgtgggtctggtgggcatcattactgggaccattttcatcatcaagggcatgcgcaaggtcaaagctggtgaacgccgagggcctctttgaggcactttcaggtgggtttgatgtagaggaaggcatatatatagaaagaattatccaaaagaaggaaacagagtggggagaaggatatgtgatatctttaaaggaaaatgataggaaagtcatgactcttaatttatctttgcgagaacagaatcagacattgacaccatctggtatcccaaaactttaagaccccatattctctccgatacatgtgcacctataccacaatctcagtcttagaaattatctccactacccaatactattgtttcacataatactaatgaatcaatgatctaggaaagctttgagtactttctggtatatattttctgaaacagtacctcagctcagaaatatttccagagcttggctctttgggggttaggataaattcactgcataaataaaaatctccttaaggccaatgtctgttttttcttctccaatctgaaaagtggtgttgaaacttctaagaaagcgtaagctctggaagctctggtctgctcatttatgttcacttggagagtgggagatgcaattcatgctagaaagtttctatttactagatagaggtcaagtgaatatttagagacacttccaaagtcaaaggatttttctttttcttttttttctaaaggggttccaaagtcaaaggtttaagggagaagacgaatgaatctgaaaaaagagcttaaaataataatcttaactctttagtaactatgcgtgtcctgctacaggcaatggagtttcctagagagaagatcagtgaagaaatttatgcttcaatagctttataaacctggcaatactccaactgttcacctcactgaggacaaccatttttttgcattttccagacttttagatattctaagaaaaatgatgtcttcctgatctgatatctagttattctctctttgctgacccttcttggatccgttttcctccattttctaccatcattttaatatcaccatgcaatgcctctggaatagaccccataggatcttttctctactacggaaccttgtgaatgttcgaaacagatatctcttctacacttagtgctttggtttcttcaaattgtgattgtgatttttttttaacacaataaactatttgatggatctgagatgaagtttttatgtctaagccagttcttcacagggacaaaggaatatatgtgatcctttcattctgaaatttgtgaatgttgaatgtatgtgataagttctataagcagtcagaaatatctaggtttggggcatgggtggctcagtcatttaagtgtttgactcttgattttgactcaagtcatgatctcagcgtcctgggctccgcatgcaggacagtgtctgtttgagattctctcactccctctgcccctccccctgttcatgctttctaaacaataagtaaataaataaataatcttaaaataaaaaggaatatccaggttcattatgaccatgtctcattcacagcatctgcaagtaatccagttgctatggtccagtccctctatggaaaactctagagtagagtttgtttgttgagagatctctgcttaggaatgatttcagaatctagttttggttcctgatttccaagtcagtgatacatgtggatctttagtagaatgaatgttaaagcatagggtttagccgcagctaataggcaagactgatgatggggagcagatgagagtggagtggaaaacagaggaggatttacatgttacaggatttacatatcaatgacactccagatttaacggaaaataggataggacactgtggatcagcattacccattttattaacatggtctttgatgcctgtgtcattactagataaatggtctgacttattcctgaaacaatcttgtattggatatgtatccccgtgcagaaaaatcaagtaaaaagtggaaagttgggggaaaacatgacattaaaatagagtgaaaaaatgtttgagatacagtgagctcttgcttacttctctgtgaaactattacttgaaatttatttctaactagttaccagagcctaccccaaaccataaagatcaattatcctgatagtttgatagagtagcaaataccagatgttgaattgacgtcaacttgggcttcatcttactctatatttactagctgtgtattcactgataccttgcttaactcaacttacttgatttgtttcatgaaaatactgatggcaatttttacacactgagttattataatattaaaggacaaatgcagaacacctgggtggctccgtggttgaacatctgcctttggctgggggcatgatcctggggtcctggaatagagtcccacatcaggatccctgcagggaggctgcttctccctctgcctctctctgcctctctctctagcagtcagaaataaataaaataattttttaaaaaaggaattaaaggacaaatgcaagaaaagtaattatgtctcatgcttagtgattgcaaaaaattataaattccattattttttctcaaaatgtttataacctgatgataaaaatcccagaaatgcacaaatcaaaagatcactttgaagggtagcagaataactcatctcaaaatatgccactctggcataaggcttattttgaggtgataaggcgtttgaggtaataaaattgctgtagattgcttgttagctgaagaaggggtcaatgccatagcaaatacctcctgctgctcctggatcaatacctctgatattatagaaagtcagtacaagaaattaacaagccttttggctaaaacacattgatacctactggtctggttcatggaggtcctgacaaaaagcatacttccctcccttggtattctcgtcctgatagtcatcatgaagctgtgttccctcaagggtctcaaacacatgctcagagccatcagcagtatatcagatggtctcactgcatttggagaaacagaaatgacatgaacagtgaggtgcaaacacctttcacaaaccttactttataacctatgagtttcacagggaaacaagaaccacttaaccctgatagtgcctagagtgatactaatatcaaatttttggtccacctcttatgtgtacaaggataaccaaaaggggataatttttgggtaattttactaggaggccattaaactgagatggctctaacagcttggtaacaacttacataagcaaagtgaaacgtaaactagagtcaatccctgtaagcactcgtatgccagcaaattcaccaatagccaaatgggcttttccaggtaaggcaactgaagagaatatagccaatcagggaattggtaaagcaatttctgtgctttgcctctgcacctgttctaccaaagcctattcctccagctcttgtcacagaactcttcaccattttcaggttggcacagccagacttgaatcatgttctcaagtaaacacttagaaattgtcttatgccttagtttatctaacaccttaaaggacttactaaaaactagcaagtttctgtattctgtggcttaaagaatcaaggcacatctttagaaatttgaaaatagtcataggtgtttcttttatgtaactcccattttttaccataaataggtggcaatagagaatacactaaaactcagacatatgtggcataaaaaagaaaacatctacaacctcccatataaaaagacattttttgaatactttacctttaatgagcagttttaggttcacagaaaaattgggcacaaaatacaagagttcctgaatatccccatctttccccctccctgctccatacagtttctcccattattgacacttggcagcagggtggtacatttgatcttaccacactgatgaatcaacattgatacattattatttacagatgtctatagtttagaatagggttcgttctttgtatgatataaatctctatagtttgccttttccagaatgtcatatagttgaaatcatacagtgagagctttttagtctaacatgattctttcatgtagcaatatgcatttaaggtcaccatgtcttttcaaagcttaatagcttttttcaaattgctgaataatacttcattgtatggacgttccacagtttatcaatccacctgtcaaaggacatcttggttgtttccaagtttcacaaagatgctataaacattcctgtgccagtttttgtggggacatatattttcaactcattgagtaaataccaaggaaaacattgctggactgtaatataggagcatgtttagctttgtaagaaatcaccacagtgtttcttccaaaataattgtaacattttgcattaccatcagcaaggaatgagatgccctattgtactgcattctggcttgctagcatttggtgttgtgagggttcttgattttacccagaagtccaccttaaaaaatttttttaatttgaaataattatagattcaccagaacttgcaaagacagtatagatagaccctatgtacgtcttatctagtttctccaaatgattatatattaaaaattataataccatatcaaaaccaggaaacatattggtaaatgtgcctgtttcctcccatgagtacatctgtgtgaccaccaccatagtcaggcacagaactattccattaccagagagttctccctcatgctgccctttgtattcacaatcacttctcttcagaccccatcacctaacaactgctaatttgctctccatctctataatttgttattttgagaatgtcaaatagatggaatcattgagtatgtggctttctgagcttggcctctttcaattagcataatgccctttagatctatctaagttgttgaatgtacccacaatttttcctttttattgctgagaggcttccatgatatggacacacttgttgcagggccttttggttgttcctagtttagggcaacgacatttaaagctgctatgcaaattagtgtacagttttgtgtgaacatgagttttcatttttctgacataaaggccatgaaatgtgactcctgggacaggaggtaagtgtatgtttagtttttaagagattgccccaaactatcttccatttcacatccccatcagtgcaggagacatccagcttctctgcattctcatcatcatttgaccttgtcattatttcatattttaagtgcttcaataggtgtatagcgatgtatcagcatggtcttaatttgcattttcctaatagctagtgatgttaaacatcattcaatgagcttattttccatatgaatattctttctgataaatgtctctttgtgtctttctcccattttgtaattagagtaggtgtgtgtgtgtgtgtatctttactgtggagacttgggagttctttattgattctagacatatttgttatgtttgttaaatttgctctttgttatattttggatgtttagatattttgtctttgtctatatctaaccttttcagtctctcaaaaggatttttttattctcaaaattattttttaataattttatttatttgagagggagagcgagtgagtgagtgagtgagtgagagagagaacattaggtggaagagaggcagagggagaagcagaagcatagggagaagcaggtttcctgctcagcagggagcctaatgcagggcttgatccctggactccaggatcacaatttgagctaaaggtagacacttaaccaactgagccacccaagtaccccaataggatatttttcagaataaaagtatttaatttttataaggcccaattcattgatgtttctcctttatggatcatgcctttgatgttctgtctaagtagtcttcaccagcccaaaaatttcctgctgttttcttctgaaaattttacactcccatgtcaagctccttgcatggagcctgcttctccctctgcctgtgtctctgcctctctctctctccctctctgtgtctctcatgaataaataaataaaataaaatctttaaaaaaaaataatgataattttttcctttccttttgttttcttttccctttgattttgcttgtttgctttgtttttgtctatggatatctattttgtctatggatatgaaatgtgttccaacaccattgtttgaaaagattatgcatactccattgatttgcactgcacccttgtcaatagtgagttggtgtgggtctatttctggactgcctatactcttccatcagtctatgtgcctgtccctccataatacccattagtcttgatatcataagtatgtatataaaggttttaaatctggctggcacaattattcaattattcaactttatttttctttatcaaatttagcttcatctcattcctaatttcattgctttttcatatatattttaagatatttaagatatttaagataactattagaatttagaataattatctacaaccattaaaaatttagccgagatacggatattaatattaattgcattaaatggggatatcaatttgagtgagaattgacatctttactctgttcagtttttcaactgatgaatatggtaaatatcttcatttatttagaccttcgatttctttcatcagcatttcagatagaagtcctgtgcacactctgttggaattcttctttagtttttctgtgcttttccttacttttttttttttttgagtgattttaatagtattgtatttttaatttttgttttacatcttccttactatatatagaaaaacaatagtttttttctgctgatctttaatcctgccttcttattagtttttttttaggttttatttgtgtagtgagggagcaattccttgggatattttatggaaactaccatcacatcaaattagtgtaaatatagttttatttcttcctttctgatgtgcctttgttctgaatacctcctattcatcttgttgatgatggggggtcccccaccctaaagaagatgagatggtttatgagattgacatggacagatgagattaacagctgttacatgtactcacagcctgagagagaaggacactaaattctatataggggcccatgaagtttgcattcgggaacacagggaatcatcagggctgagaggcaagctttgtaggaacaagaagatgaggtgcctccgggttcccacaactggatgttattggtttttttgaatagttctatgggcaggcaagggaactgaagcccttaggttgaggaacaggtggactgtagcttttcagactcagaagtagctgagtgaagtctttccttccaggttgaggaaagatacctggtctaagtgtgggcactcatggttatgctttcggcggccctttaaaggctttgccacagtaattagtcccttctgtcttattgatggcaaggattgaaggagtgctcaaatgaggtgttttgagacaacaaacactttagtaaatgctccaggggattgatgctcctcaaagtaggctaaaaatcctcactgaaggaagtcagaagaaaggttttaataggataatactgaggatgattttaaatgggcaaaggaaagccttacctaatcaatctatttgcacacccaaattgagaaagctgctcattaaactaaacaacccgagtgaaatactgacaaaattgagctcaaaaatatcaactcctgtgctcgcttcggcagcacatatactaaaaaaaaaaaaaaaaaaaaatcaactccttcatacttcctacttctctaccttcttcttatcctgtaaatgagataccagggattgaggcattaaaatcaaaatcctccttctcctcaccatgctaaggcaatgaaagttctgaggtcaagagctggctagagtagaagctgatattaagaggctgataggaattcttgaaggccttctccattaagaacaaattaggacaatgtacccagagaggaagaagcaaattgaaggcaaagtgatcagatggatagatcaaccgatgatgtcttttaagtgaccacccaattccctgagagattgaaaacaacagttaccctaaaaaagaaaacatcattgctaaacatgaaatataggcccagaaggaattcaaagtccttcaggttctctaggaactcttatctagaccattctctgttcctaagcctgaagaaaaaagaggtggcatgtaggggatggggtggtgtgggggttctgtggaagcttcttaaaattcaactggctagaaaaacactcttgctccaaatctaacccagtttccagaagattacttgtcaaggatacatacaaatctttactatctgtgtttatatatatgttataaatatgagattgctctatcactggatattgataaaattagtttgtaaaatagctttttacagttggtgtgatgacaggtatttataagaattaggctttttaaaatttacaagtcaccaaacaacagatgttgacaaggatgcagagaaaggggaactctctcacattgttgatgggaatgcaagctggtacagccactctggaaaacagtgtggaggttcctcaaaaagttaaaaaaaatagagctaccctatggctcagcaatgtacttctaggtatttaccccaaagatacaaatgtagtgatccatagggatacctgcaccccaatgtttgtagcaatgtccacaatagtcaaactatgggaatagcccagatgtccatcaacagatgcatggatagagaagatgtaatatacatatacaatggaatattactcggccatcagaaaatgaaatattgccaattgcaacaatgtgaatggaactagagtattttgctaagtaaaataagtcagagaaagacaattacttttttaataaatttatattttatttgtgttcaatttgtcaacatatagaataacacccagtgctcatcccgtcaagtgcccacctcagtgcccctcacccagtcacccccaccccccacccacctccccttccaccacccctagttcgtttcccagagttaggagtctttacgttctgtctccctttctgatatttcctacccatttcttctcccttcccttatattccctttcactatcgtttatattctccaaatgaatgagaacatataatatttgtccttctccaattcactcatttcactcagcataataccctccagttccatccacattgaagcaaatggtgggtatttgtcgtttctaatggctgagtaatattccattgtatacatagaccacagcttctttatctgttcatctttcgatggacaccaaggctccttccacagtttggctattgtggacatcgctgctataaacatcggggtgcaggtgtcccagcatttcattgcatctgtatctttggggtaaatccacaacactgcaattgctgggtcatagggcaggtcttctttgatctgagtcctactttaactcatataaccatctctatttttttgttaattgttttctatgcttatctttttccattcctctatttcagtcttcccatattattaagtttgaagtgagcttgttgtagacagcacacaattggatcatttttctccagtctggtgtttgtctgttaactgatgtttttagatcatttacatttaatgcaattattaatatatgagcacttatgttggacattgtatcatttgttttgagtgtacacagctcctgaatctttaggtgcatgacttttgccaaattttggaatattcagtcaagtttccatcaaaaagtttttcagtatcacttccttttcatctccttcttggtcttgaatagcacaaatattttatctttatttgtagttccacaaattctcctacatgaagtaataataaatattatgagcaagtttacaaaaataaaattgtatgtagtggataaattactcaaaatgtgcaatgtatcaaagctcacaaacagtatataaaattaagagttccacatcgaatgaagaaaataagtccattatgcaaaacttttccacaacaaaaccccaagtttagctctccagtaaattcttaaaagtatttaagaaagaagccatcctaatttatacgaacttccaaaaaagtgaaaagagagaaaacacttgcaaatacttcctatgagaccaggataatctttttttcaaaacctgatgctgtaacaaaaagaaatatacagactcatcactttcataaagacagatgccaaaatcttatgaaaaaattatcagattgaatccagtgacattcagaaagcatgatacatcatggctaagaggaacttattacaggattgcaagattcttttaacgtttgagaattaattaatgcaatttaccatattaagttaaagaaggagacaagaaatataatcatcttgatagaaaaataaaatatcattggacagaattcaacacctgtacttaatttttcaatatctagattttaaaaattttatgaaaagggaattttcttgatttaacaaagaatagctaccctactacacacatcagactcattttattacccccaatttcctacctttggcaatcacccatctgttttctgtatctgtgaacaaggctttttgtatttttgggtttgggttttttgggggtttttttgttttgttttgtttttttgggggggttcaacatataggtgagatcactttaatttgtctttcttgttgtgatctatttcacttagcataacgtcctcaaggtccattcatgttgtcacaaatagcaaaacttcattctttcttatggctgaataatactttttaaaaaagattttgtttatttactcatgagagagagagagagaggcagagacataggcagagggaaaagcaggctccctggagcctgatgtgggactcgatcccaggactccaggatcatgccctgagtcgaaggcagacatctaatcgctgagccacccaggcatcccaggaataatatttgttgatgtatgtataccatacttgctttactcattcatctcttgatggacatttagattatttccatatcttcaccattgtaaataatgctacaatgaataaggggatgcaaatatcttttcaagttagtgttttaattttctttatttaatcacccagaaatggattgctggatcaaatgataggtctatttttcatctttttggagaatttccacactgtttccatagtgactgcaccaatttaattcatgccaacagtgcacaagggtttgttttctccacatccctaccaacaacccttgttatttttgtctttttgataatagccatcctaacaggtataaagtgatatatcattgtggatttgatttcttttttccctgatgattagtgatgttgagcatctttgcatgtgcctgttagccatctgtatgtcttctttgggaaaatgtctattcagatcttctgctcaaattcaattggattggggtttttttattgctactagttgaatgaattctatacatattttggatattaacccctcaccagatatatgatttgcaaatattttctcccattttgtaggttgcctttcattttgttgatggtttcttttactgtgcaaaagctttttaatttgatgtcattccacttttcatttttacttttatggcctttgactttcgtgtccattccaaaaaaaatcatcaccaagatagatgtcaaggagcagactgcctatgttttctctcacaagtcgtatgatttcaggttttacatgcaaggctttaatctattttggattagtttttgtgtataatgtaagataatgacccattttcatttatttgcatgttgctgtccagttttcctaataccatttattaaagagactattcctagcccattgtatattcttgaaatgctctactttaaacctcaagtgttcataatctacttctggagtctgctatactgctgtatttaaccaataaggaatcaatcccaaagagtgtcaagcaaaattgatatataacaggtttaagcattttatcaaacttaacacttattgtctttgaaaattttctgggaaatatatttttccttataaaattaagtattaacatgttaacttctaagaacaaatagtccttttgcttagttgctgttttttttcattataattgggtttataactgcattttaatactccgtgttaaaaacaaaccctcaaaacctttattgatgcacccctcaacctatcatccttcatgatgaaataattaaaaatactaacactctaatagttccagatactatagtttccttacctaaaattgttctcttctacccgctctcacatttctttctttctttctgaagattatttgctcccatctttccaatgcatcaaatgaggcaggccccacaaagcatgaagcatagtttgtctgagactaccactgtcattctgtggtcctctcaatgtgtggaggaagtaggtctactgagaacacttgaagaaggtttagttctcccttataaaaatgtatgaggagaaactgttcccttttcctgtctttggaagttatgaagaaaatgaagcctaaagctactgcagccatcctactaccatttcaggaatactgacttgtggtgtatgataaagagaagagatacaaagtcccaggatcactagcaacaccattggcctgatgaactcaccagcttggaggttaactacccagggtctatctgctacgtgagacaaggagttaaagtcaaataaagccaattaaattgatttttctcactagcaatagaaagcatcgccactgaaatattcctgccatacttttaaattctacattataatgtcacaccatagatctcagataaaatgagacaactcatttctgcatcttaaagaacacaacaaaagtaaagttgcaaccctgggatcaaacagcatctgattaaaccatataaatattgaacacatgactgttagcttattaaattcccacaggaggataacctgtttcacacattaatgcataatagaactataatatttgtaaaataaactttgaattggtctgttgtctcttatagtggagaaattgtgctgaaatagctattaacttgaattgaacttctgaatctattgtctactctttagatttgatttacttttcaaaatgacttgtcgacagattatgatagcagaactcatcatctccttaaccaatttaggtgtattctctgaaacctttccaacttttttatattattgaagtctatggaatctagaactatatactgatttacaattatagttccacagtgtccaagctccaaaaatacttggtttacttttctaatttgtttccattatgtactttttgtcacattttcttcatcactacagtttggttttaatttttacatattgactttttaaattttttaagttattatataaaatgtttttaggatcctcaaactaaaactattaactaagacatgtttagaagatccagctctcatctctgttcccttcaacctactcattcattttgcccaagaggcaatggtttttaaaaaatccttccattgtcatatatagaaaagtaagtagattagatagatgagagataattatagctggatgttatagataaagtgatatagctatatattcctattctcttactctatcttttaaacaaatcgttgtgtgatgtacaaactctcctgtacctgtgcaaatgccttttggagattattccatttcaggatggttatttttccatccagctgcatggtatttcattgtttgcatggacatcagagtattcataatttcccctttctttcccagttttcctctgatttctgctaatttcccctttctttcccagttttcctctgatttctgctaagataatatctatctgggatgttcctgtagatggtaaatttatgtacaatatgaaaggtctcagaaatgcatcttttcccctagagttgtggttttgtcctgatggtctgagacctatttatggggaaggatgcatctcaagtcaaagtgtcagcatgccatggatgtttatctgagagacagaaaaagatggaagtgtagatagagctccccatcaatataatgagaggggtttactcagttttagatactttcctataaaactcaagaagggggaattgtgagcctcccgcattaggcatggagcctacgtaaaaaataaaatgaaattaaaatttaaaaactgaggcaaaagacagtgattataaaaattctgagggcatcatttccttacaagttacttgtatgacattgcatggatattttttgttccctttcctcatcccatggtgcaaagggacgtttgtgtttgtgtttgagaacacagagatataggataccactgtcacataggtcatcaagggcttcctcctagctccagaaaacatgcctaagtacagaatgcatagagcccatgattaaacagagaatgaagcaaggatatctttcagatgcatatctgaacaaaatttaggaatatcaataaaaaccattatttttttgtgatgaatcctcccattctccctcttttttttttttttttttacttctcttccttgaaaacacatgaagcagatgattttcaatccacatttatttgagaaaagtttataaagaaacatgagcagaaggtgagttcccatgcaagggaaacataagggctgcataggaagaggaaggagagaatgcagataaggtactgcagtcagcactgggggttccaggtcaaggacagggcagagggagccattggggaacacaagctgtgcagggtcactgaagccagggcaaaccagatcctgagaaagcgctgtatttgtagaagaataagagccaagctggaaacctttggactctgagaagaagctggaaaggaaggttttttcttgagggtcaccatctccacttcagctcaggagtcctgcagaagacagagcagagtattgttccagacccacctctataagcagcttcttctcctctctctcaaggcctcatgtcaaagcgctgcagtaattacatatttttaggtctccttgggccagagctattttacagcgcaggcctttcactaagtggagagaggtagcgtcagtataaactgccagatcagaagtcagatccaaagtctttcccactgggatgcttgggtggctcagtggttgagcatctgccttcagctcagggtataaccctggagtcccaggatcgagtcccacatcgggctccctacaaggagcctgcttctccctctgcctgtgtctctgtctctctctctctgtgtctctcatgaataaatacataaaatctttttaaaaaacaacaacaacaacaaagtctttcccattatttctgtcttttcacctttactatctgctccaggataaccaaatctatctgtaaaggggatgaaggagcattacctgttggctgaagtccagagtgtcctggaaaagagaagggaagacatagacttaacagatatggaggtaaatctggccccatagacaagattccagccccagacctgcctccttagatttctctaacagcccaacccatattgcatgatgccaggggagagtggaaagtgaaagatatgacccatgaagtctctgtcacacaaatccagtttcattagctttagcgtctcttcctgcatttggcccaggatctcaacccaagatcctcatgcttgttaatctccttcttagctctacagaacacatgacctcttaggctgtgacacagtaaccatggactgctgacttctggatttctagggaatctgaggtcaaattgggaaagaatggctttatacagggccatcggtacacagagagcttttgatcaaagctgtatttctctccacatagtctctggggagtctcagttaccaacaggtgccttacccttctgatttctgaagtagatgaacagccccactgcaaggaagagcagacccaggacaaagcccccgattccactcagcatcttgctctgtgcagaatcagactgtgcccctgaaagaagaagcagttttagtgctttttacaccaaactgatggacactgggattgagaatgtcactttagtgatttttacaccaaactgatggacactcagtttgagaactttgagaatgaggaaggaaggctgccttggaagaagtagaataattagcaatttctggaaaagaaatctaaaatcacattgagtagatacgaagtctatgcattgacctttttaaatatcacaattctgacaaatccactacttcaacatctatggatgaggagcctgggactccgtgaagtacaagtagcttgtgcagggtgacagagctaataaaaggaatccaagattggattcccctcaagtcagaaaggtccctacaatgtaaaggattctcagatgacaatgaagaactcagagcaacagtgccagaagcacaagcccagccaaaggcagtggactggtgcccagtgtcaagatggaactctgacctgtgaaccatggaaaatctgaaaacatggataacctcctttctgcctgccacatctaactgcctccccaaagactgcaggatctgtagaaataatcacaggatatcttaaattatcagaggacatcactcagctacccccagggacctgtgctaaacagaagagaatacggaggaaaagaaaatatggtataaggagagagaaccctgacactcagaaataagcaaatcccctctttggtagttgaggaacttatgtcaggaagcttctcactccattccacggtgacagggcttgtcaaacttgggtgctccacttggcaggtgtagacctctccgctctgaggaactatctccagcatcaccaggatctggaaggtccagtctccattacggattaggcctgtggacacaaccccagcttcctcttcctggccattccggagccacctgacttcaatgtggcctggatagaaaccattcacagagcagaccaggaggttgtgatgctgcaaggtctgagtcttcgtaggatacacagtcactgtaggctcgactagaagagaagtggtagagggactcagtgaggaagacagacaaagcaagtctccctggttggctgccttgctgcctccagtctctggtcacaggctgcatttcaagcaggcttccctcaaaactgaccatgtggcccaataagggccagtgtcatgagcctttttttttttttttaaagattttatttatttacttgagagagagagcaagcaatagtgagagagagagagagagagcacaagtaggggagagaaggagaagcagactcttcactgagccggaagcctgatgcgggggcttgatccccggatcccaggatcataaggtgagccaaggaagacactcaattgactgagccactcaggcgcccccagtatcgtgactcttgaatttaatcctgactgcatgagtccattagatttaagtgatgttgcagaaatttgtggggtttgtttttcatagagtgaaacagtttcttgttgaattgaggtgtttacaaattttgcaaggcatataatgtatttaagtaaaagcatgatttctagagaagcctgactaaattcacgtccagactctattactttactgattcatcctgggagaatttttacattcttctgtgccccagctttttaacctatcaaggaggatagtaatactaacttagctctcaaggttacatgatactaatgcacccgaggtatataaaacaataactggaatttagctttcaatatatgttaccttattatcctttttaattggggagaaaatatgatttgaagaagtgttgctaaagtggggaacaccctaagatagatgggggaagagagtaggacatcctgggaaagccacactcacaccttagaacaccatggaaatggatctaccctgggaagcaggaaagacagaggtgcttctctaggtctgggagctgagtcccaaggacagtatgagtcctgaaagggaaaggagcaaaggaactcatttatttaaaaaagttcttataattgcatttgcctgattactccttcttctttgcaatatgaaaatatccattattataattgtcatcatttcattaatttattaattataaacggacatttgaattcaggggagtgtctgagactcattaaaaggtatccttagagcctaagataatccctgacactacagcctccataaatacaatttccgtttttgtaaaaggagaaatacgaggaaaaccttttacaaaccatagaattatagatctaagattgatgacaaatcattgccaactattttgtagcaaatttcattcaataaaaatgtttacattcctagcatgaaaagtaataaacagaatcaaaatataaaccacaaactagggaaaatgttgaatcaaatatcaggaaagctttaataatcttatgcatggagacacaaaatcactgaggaaaaaatgagaactctacagataatagacaggagataatgtttacagtagcaacaacaattagccaataaatatgtgaaataaatgttcgagaactatataaatcaaacaaatataaattaaaaataaaaaagataaatgtttggcaatatggataaaaaggttctaacaaagaggaatgcgaggtgaattgttatgactatgtaaagaaatcacatgcaactccttaaatactttcatcatcataaaaataggaacatcagtatgttaagtaagaaagttataattaaaaaatctgatttgcggacgcctgagtggccagtggttgagcctctgcctctgcctcagggctgatcctggggtcccgggatggaggtgttccccccacccacccacccccaggctccctgcggagctctgcctgtgtctctacctctctctctgtgtgtctgtcatgaataaataaataaaatattttttaaaacaaacaaaaaacaccagctttcacaatcatttcatgtaagaatacatacactaggaaatacaaatcaagtagctgagacccagaggaagcctcagaaagatcagagaggcctccgaggttcccttaccccctcaaaacttagtggacactttttctcagtgaaatggtcccccccccccccccttttgacccgttactgatttgtctcgtggttacgggatcagaaaggtgttattccccatttatagatgaaagaactgcatcaattacaccattaactctcttgcgccctgtcacctacctctattctgagataccaataggctaacatagcaatggagtccaaagtccaacagagtatttgagagtgtgcttttaactgagtatttgaaatttattcccaataaccagataatagagcaacaattctgttgttcctcagtattttcctaatgccttatacagtgttttcatgaaacacgtgtagttcaacattgaaagacagtgtgcagagcatggggatagggagatgaggtataaaaaaaagaaacaaaaagaaactacttctcctcaaggcagcaacatcaactgtgggtctgtggcattccctcaataaataccaaataggaagtgatatgtgcaataatgggattgccattctccatagtaacaggaatagcattatggaatccacaaaagagagagggtttgggaatcagtagattccatatcatcactcttctgttgcctgttgggaggctctaagcttaatcttaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaactcctcccggttatggatgtgtctttccacgaaccgcacccgctccgtcccgttggtgaaatggcactcgggcttaaactggtacacgaaatgtgctgtggggacggggggatccggtcaccagaggctcctggaagacaccgacggcggcaccccgcggcggttccacccgcaccccaaccaccagcacccacggttcgtgtttcctccgctggcgggggaggggaggcggcccggggggacgagaccccgctcaggggggcctttggcggccactcggctcccggctcgggtgacccgacgcccgccagcgcgagcagccgcggccttcacccctccccgccgcctcccggacgcctccccgggacagacagcccctggctcctcgccctcgcccctggctcctccccctcacccctcgcccctcgcccctggctcctcgctcctcgccctcgcctcccgcagccctttacctgtcctcaaacacgtccctgctgcttccccctggtttgggctgagccgcccctgtgaatccagagaagggaagacacacgtcccctccgctcggggagctcaaaatggagggaaagtgacggaccaaacccaaagtggcaagactttgtacagaggtgaggaatgttagagggatgaagttctagaactgagaatagttgggtggtctgaattacctgggtgccagagaagtagttcaagggtgacgtgagatgtgacatgaaggatgaagtagatgcgccgagagagagagagagagagagagagagagagagagagagagagaagagtttggggacaaagggaggcaccattcaggtcaaggtaaatgtgactgtgcaagagcctgaaagaactgatgaatttcctcaagaacccagaggaaacagttgatggaaacacagacagtgagaggaaggagagggcagtttcgactggagtcatcaaatggagcccacaagaaaagcccgtgggtggtgacagcttttgacttttatactaaattcaatgggatgtgactgaagttttaacgagattaaaaccatgatcgcaatacagttctcaatcctttacctacgtttccaaattcagaaatctcagaaaaccagatctttctaagaattttgatgcagaacccgttggcaaatctaatctgatgaggtaagggtcggtcagagctcttactggtcagtcacgtgtgcttctgtagtttcaatatatgtaaacacacacacatcataattcatgtatatatatatgcaaacatgtatgtatatattttgatatttatgttttacgtttaattaaattaagacaagtgttttattcaagtataattaacatgaaaatttttaaaatatggaaaaaataactgtttaaaagggagacaaataaaagagagcatctcacattattaatagagtagattgtagaattagtacaaaagtttgacatattttactaaaaaaatatttgtggcagtcacaatttatgactgagatggggctgatcaagaaatcatgaaatactgaaaaacgttgcataaggcaaaaaataaaaaacaaaaatcttggcttgcattgattgaattggctcaacaagaaattggtgaatttacacaattttatactttattacttctgtatttaaacaaactaaaataaaccacaaaggcctgaattggaaggtgaatgtgtgtataaagtgtgagtcaagaatttttagaagccccacagtatataaatcagtgtttttgatctcagcattaacatttagagttaacattttagagtttttgtctgattctttgtttgaaatcataccctgtatattttccaaccacaatggtacacaaccaaagaaaataaaacaaaactggaaaatctataacgttaatattaaatatttatttgtaaatattaaacaacacattactatactagcaatgggccaaaaaaaatcaaatggcaaatcaaaatatgtcttaaagcaaaagaaaaagaaaacataagtgaaatttatgctataaatgcttgtattaagaaagaaatctcagctttcttctccagccacacaagatgctgaaaggaaaggaggctaaggggaagaaggtggcccgagcctctgatgttgtgaagaagtaggaggccaacaaggttgtcaatatcctgtttgagaaaaggcccaagaattttggcatctgacaggacatccaacccaaaaggcaccttaccctctttgtcaaatgcccctgctacatttggtggcagtggcaaagggctattctctataaacgtctaaaagtgcctctcacgattaactagttcacccaagccttggaaggccaaacagctactcacctgcttaaactggcccgtggatacagaccggaggcaaagcaagagaagaagcagagattgctggcccgggctgagaagaaagttgccagcaaacggatatccccactaagaggctccctgtccctcaagctagggttaatactgtcaccaccttggtggaaaacaagaagactagctggtagtgactgcacatgatgtggattccattgagctggttgtcttcctgcctgccctgtatcataagataggggttttctactgcatcatcaaggggaaggccagactggggcatttggtccacgagaggacctgccccactgtcacctttatacaggttaactcagaagacaaagaagctctggttaagctggtggaagcaattaggaccagttacaatgacagacatgatgagacccactgtccctggggaggcaacatcctgggttcaaagtcagtggctggcattgccaagctggaaaaggcaaaggctaaagaactgaccaccaaactggactatgggtgtagtgttgaattttctgtacataaaagcaataaaaagtactctttcagccagtgtcaaggaaaaaaaagttcaaacaaacaacatcacaccacaaggaactagaaaaagaagaaacatgggggaaatttaggagaggaagaaagtaacaaagaaaaatcagagataaataagagaccagaggggatccctgggtggcgcagcggtttggcgcctgcctttggcccagggcgcaatcctggagacccgggatcgaatcccacatcaggctcccggtgcatggagcctgcttctccctctgcctgtgtctctgcctctctctctctctctgtgactatcataaataaataataaaaaaaaaattaaaaaaagaaaggctaagctttgtaaaaaaataaataaataaataagagaccagaataacattgaaagtaatgactagttttcccaaaaaataaacaaagtttccaatgctttatctacattaactaagaaaaaaaaaaagagagaagcctcaaaacctgaaatgaaaaatggaagagaaaataatacaatagataatcatagcagttgacagtttggacaagataatgttgggaagcctgttctgtacattgtaggatgtctatcagcatcactagcctctacccactcaatgtcagatgaaacctcagcttaaaaaaccaaacaggggctccagacattgctatattctctggggagggggtaccaaaacaattcctgcataagaaccactgttatattaactgaaatatatgcggtgaaaaaactgatgctaattatggaacagctgagtattacattgaaaaatttgccaatatcatatctgataaaaagcttatcccaaggaaatgtattttgctataaaatagctcagtgctgggatcagattcctaaaaaccattcataaggcctaataagagagtatcaaaaagctgctaagaagtctaacataaagatgattgttcttggctgtgctcatgcatcaggctcacccagaacaaagtgaatggtgattgaaaactaaaatccaggcactcctaaaagctgtaactattttacctgtgcattattttcaaacaaggcaatacagataatcagatacagattttctaactggctcaatcactactttgcatcagtgacttacattcctgatggccacgctggactgtgagaaacctggaatgtcattatttctggataattgtgccacatatggctcctctgaacttcttgtaaaaactaaagcttttggccctgaatttcccccagtatgatgtctgtgttgaaatattgtgaccaaggcatttttatctcttcaagagcaggtataaacaattttcaaattccattctttttttttaaaactccatcttttttttttaatttttatttatttatgatagtcacacagagagaaagagagaggcagagacacaggcagagggagaagcaggctccatgcactgggagcccaacgtgggatttgatcctggatctccaggatcgcgccctgggccaaaggcaggcgctaaaccgctgcgccacccagggatcccccattcttattgcagtttacagagaagcctacaaatccatggctttctgagagcaatcagttactagtgcctattatgtatatgtgctgccgaagcgagcacgctagtgcttattatgaagctaagaattaattaaacaactttaacaaatgtttggcacagcctttaggttacgttcatttgtgcatgaactagcagatgaagattttgaaaactgtcatgtcattaatgaaaaaaaatcacatcaaaacttcaatataagctagagttaatgagataaaaatctaaataacatcaaaaaacactgagcactgacaatgaggccatgttgggcattccctgagtgctggaaacttggtagtggtgacaaacagcactccccagcttcctccctacaatccagcctctctagtcttccttttctttttttcttcaagtttatttatttatttatttatttatttatttatttatttattatttatttatttaagagagagaaagtgcatgcatgagcagggggacaggcagaggcagagggagaaagaagaaagagaatatagagcagaatgccctgagcatggagcccagtgtctgacaagaggctcaatctcatgacctgagccgaaatccagtcagatgcttaatggactgagtcacccaggtgcccctctagccttcctctgtcttttaaactcagcaaacatcttcccacactttggcctctgtcctgttctctcttccctcaaattcttcacatggtggacttttcttcatcagtcatgtctcaactaaatgtcactttctcagggggagctccctagccacttgcaatgtagtcaggtgaatccagttctctctatttcacaaacctggtgtgtttttctcagagcactgattgctctctgaaattttttcttctttaaatgttttttgggctttctactctgtcagtacactaccacttatgatggtagtgattttatcttattcaaatagagttcactgagcctagaacagaacccattacaaaataggtgctcagaaaaatatctgtgatttaaacaaataaactcagtgttctgagaatcagtcactgtaaggatcctgggaagtaaaaagaggctttaagcttcaacactcctttatttttatgatatattatttcccttctacttcctgggtgaaaatcaaacaaacttcctctctctcctactgttctaaaaaatatcacggataaagaaaagttggctttaagaaaaaaaaaaaaaaagaaaatttcaggcagcctgagtggctcagcagtttagcattgccttcagcccagggtgtgatcctggagacccaggatcaagtcccacatcaggctccctgcatggagcctgtttctccctctgcctgtgtctctgcctctctctctctctgtgtgtctctcatgaataaataaataaaatctttaaaaaaaatacacaacatttttttaaaaaaggaaaatttcattaggtttcagctcatcctgtttgtgataatgctgaaggtctgtgcgaacactgggcattctcagtaatggtgatgacagagttaggaaagaatagtgacaaactggaagtggaagcaaccaaatacggctatttaaggaaaaagaaaacatgatgaatgaatctatgcaatttgagaccaagacctcagtaaggtagtaagttcagtttttgctcttggctttcagtcctataaaatgtaaataaccttcactctttctgtaccttgctcagggtttgcagttcgaatacatgaaattcctgatatttgactaattttggctttcaaaaacataatttcatataatttctccaatactagttgaaccccttcctgtgggctcagggcaaaatgggaatatgcaggagaaagtgactctatagaaaggttcgaaatagattcataatgaaaattaacctgtgccaagttcttggaagagatattaagttctttaagacaccaaagaacacccaatatgtgcttcttatttactgtattatttcaagtactaaagatcactgctgtagctccagggtgagatatagagataaaaattaaccccaacttttttcagagaacctccagtataggataaaggccttataaactttggggctcaggagaaaggaaaggagatcatgggagaaacctcttgatacattctcacatattagaaagagacaccaacataactgatccaatgaagacataaaacagggtcttctcagagagaactttctaattctttttcattcaccataaaattttcagagaagctttcctactttctagcataactcaacataataaagggaactacttgatgggaattaatttggagtcattatttctaagtcttctcaagaccctgatggaatgagatgcaagcctgaaaagcttttattggaggagagttgagaagaaatggcctatatatatgaaagaccccttaagcaactcttgtagagggcaagccggtgaactccttttgttctcaatagaattgggggtctatatataataaaaattggtggttattgaagaaaatatcacaattttctaagggacatagcctggacacagtggcaaaactaatttctttcttccctccaacccataatatcttaccacccaaagtgtgcacttacgtggggtgtccctggcccaagccaagggagggttcagcaccatcagtatcagcatcagagctgtcatccaggagcctccaagaaaacacagacacaccatgctggaaaacagaaaggacagggtgcaggggagcagtcaggtgtcactcagtgaagactgggaccctactttggccacatcctaaataacactaaccaaagaattcatttcattgtccctggattgggtaatcttggtgataagaaccaatcagcaacagcaatatattgcatcatcagttgctggtcagagattcagtatgaagagcctcttctgaaactttgattttgttcattgaaaggattgttttaacttaatactttaaagatttgatccaggtgtatatgaaacattttattggacccctattgtgagccagttctgtgctgggcagtgatgtgcacgaaagttcgagccttctaagagtattcatgtctctcttgaagacagaattgttttgatccatgtaatgtgtttttaggagctgaggacatggagagtgattgcaagtcaagaaccctttgctctggaccttgctgcaccatcacttagtgttgtagatttgaggaaaatatttaaccttaaccttgaaatgaaggcactgcaatctttctggtacttcgatatggaaagtgatgtgattctctggacagcccaaggagcagcatctcctggtaactgatgatataaaagaattatggctattgattggagagtatagtattacctccttatatgtagggaagtctctggtaaagctaaaggaattgaaattcagtcattaaattaacctgagttaaaaggtccttcaagtttatttcctgatacaattgatgggggaacagaggactggctgaggacaaagcaggagcccagggcagcacattgacaagcccttgaaacaggcagagagacattcctctacggactcaactgcctcgatgttcatactttgctaaggagaaaagggaatcttagccagacccccaggatcctgtaagtctactttaacataaaattcctttagagagttcctttatctctaaaccccaaagatacatgttggcaatcatcccccaagcacatggcccacccatacacatctgaagggtctcatgactcaggttttattagacggtaataagtgaccttttcccaacaataactagcccccagcaaggtccaagcaaggtcctggaaaccttgcttccaaaatcccttagacacttaacctatccctaaccacctcccaactcccaggtatataataagccaccttcacgggccaggacagcagctcttcctgcccacgggtcctgtcccccggctttaataaaaccacaattttgcaccaaagacgtctcaagaattctttcttggtcattggttccagacctcacctatattccaaaaattcattactatcattgagtttggaggcatctccagaatatgcataaggaaagggcttagaacatgatctatgtggaatagagggtcttgaaagttccttcatatagcacttaacctaacaaagtgataaggccaactgcccaaatctacacttacagggagctaagagattgataaaggactcaaagtcagcttctagcgtaacagctctgctttcggataattaatatatatgtggcaaatatgttcaatccatactcctggatcccattctgttttcctcattttactggatatatgtttttagtgtgcatcttctcttgctttgttttaaggagacatataagaagctggtgctaatgaatacattatagaatgttcaggaaatagaacacaatggaaatattatgaattatatcctttgatataaccatataattttaaacatatatttccacttttagaaaattattatacattatattaatataaatgtaatatctcagattcagaatggactttttaaaagattttatttatttatttatttatttatttatttatttatttataagaacacaagcagaggaggaaagggcagaggaagaggaagaaacaagtccctgctgagcagagaatccaatgcagggctagatctcagaaccctgagatcatgacctgaaccaatgtttagccaactgagtcacccaggtgcccccagaatggactttaaaggacaactatctatctaaacttctgcattaattcacattctaccacagtctgataaacagtcctttatggactagtgacaaactatggataccatgttgcaataacatgactaatatttactaagcaaattttgagcattttgctttgcacccagattataaaagggctatttatacatcatatttatatttaattctcacatcacctcagtgatttgagtaccctttgcatccttatggatggaaagaataaaatgataaatgacattaaaaagctttggcaagggcagcccggatggctcagcggtttagtacgacgttcagcccaggatgtgatcctggagacccgggatcaagtcccatgtcagactccctgcatgaagcctgctcctccctctgcctgtgtctctgcctctctctctgtctgtgtctctcatgaataattaaataaaaaaatctttaaaaaataaaaaagctttggcaaggacacaaggcaagtaaatggtgtattccagattgagccaagttatatgtgagtctaaatcccacacgtccaaccattacaccttaccatctcacatttaatttatgatgagaatagtgaccattatgttaaaactattattgtcactttaattcatggttatggatgtctatgtgactactctttttaatgaatacagaactttatataaattgaggcaattcctctgtggtaattgtagttcctcccaaagattcctctcatcactatcataaacatcttgtgaaaatgacaaaccatgcatttatcttatgcaatggctcccaaagctcctgcaaatgtccttcttattaaaaataacagtggctccaaattactaaataaaatctattgttctcaatcataatttcaaatttctcagcatgatttattacaaatttaaataagtcaagaatagatagaaattttatctcatatagtttggaaaaatgtatttctgctaatgaggaaacttcaaagtatcttgtacaagtgggataaaagtcattgttgtccctggatttcagaagaaagtatgttcctagaccccagttttaattcagttctattgtaagttgtacaattgcaaccaggagaatgccatatttaattttagaaattaaaataataatttactccaaattaactgctgtaccagtgacaatctgggagagtcaagcttaaattcaccataaattataggataaaaggaatggcaaagaaaagtaattgtgtgtcaagaacatacatattgaatatattgaaatatcaaagagaatactatcaaaacttgcccatataagtttgacaatttacaaatcatacaaatttatttttgaaaaaagtaggccagcaactatgacctaaattctgtagttgcatacatttatgagtaacaaaatgtgttgctttaaatattatatatttcatacttttcttcaacattatttcagtataaggaaaattcaggtaaaagaatataacaacttttaccaaaccaccaatcctacaggtgtctaagctgaacttcttcccgtgaagcaaaaggagcagttctcaacttctgctgtgtataaggagtgtcaagtaagactttatttcctgaagaagagatggttaaatcggtttctagaagagtggttatcaatacacaagttctacagtttctgttcttgatacatgaagtgataggtttgttttcattgataataaatcaaaacacttttgggaactaacaaaagacatcagaagcacaagcttttgttgaacacaggcaggtggaaatttgcagcatcacaaaatgtcttgagtcctaccagttatcacagaatgggactcatttgtggtaagcctgaaaagttgcaatatatctgggaaatcagcaatccacagaatgttagcacagaatgtccatcatttatccaagtagtctcaaaatattctctgcagttctcagacagctatgaccatgaatatggaactgagaagtgagaagcaggtcagaagtccctttatctaagaaaaaatagtaacaataagaagtggataaatgcggccaatttcttctaccatggaagacatgtatctttggcagaagactgtcccatttacaggtcatattagcacttagcagacttgataggaccctctccagtgagatctcatcaatgatgtcttctattggggaactttggatgaagccagtctttatactgtggcattacctaagtcaatagacagggcttctccaacttctgaatgtcattttttgactcaatttttctgtgttttgtaatacttaacatgcactcttttttagaaccagaatgtttgctattgactagtcacagaaagaacaactagaattctcataggcctgtcattaatatcatatgtaggaagaattttagtttactttctttttgttctaggccatgttttaattgtactcataggcctgtcattaatatcatatgtaggaagaattttagtttactttctttttgttctaggccatgttttaattgtactatggcaaaatacttatctcttatctggtacaaatactggccatattatttttcaaaattctgctttgttgtttcattagtcaactgcccattgattcttgttgtgtgcctggaatgttgtctgttttgttcaaaactaataaaatcttttagctatttgactaatagttcagcagcctatctccttataaacaagcaagtttccaccctgagaaagtaaatttattagtaattataatttcttcctacatggtatgcctgtaaaaaaaaaccccaactctttcaatactggagagcaattttgagaacattaaaacataagactctcactaattatcgctggcatctatattttggtcatatgttcattccatagtttatacaagcaagaaaaggagcataacttggtgctattacacttccacctaaagatgctaaagctgatttgggtgcaatgacaacctctcagtttttagagttcagaatttagtacctgaccttaaagaaaaagttttcagatgaattatgtcagttgttaaaataggatccaaggggaatttaatttaaaaaatatatatattaaccaaggaatttaattttaaaaaatatattaatatatatattaattcaaatttaatttaatttaatttaaaatatatatatatattaaccaaggaaaaatgtttcctaataaccacaacagaagataacataaagacacttagaaagtttaagcttcttcagaagtgaggatccttattgcttttacaatttttaagctatgaaaaccacaaaaggattaataaggatcaatcctataggcaatcgattctgacatgcagcaaaatacatagctgttggtttattttccatatagaacagcagttaaacacaaaattattttaactgtcaacatatcctttagtgctattgctggtttaattgcaatatcattaatattaaccatggtctttttaatctgaagttttatagccatgtgacttcaaactatcagaaacaagctccttgtggacaattccctggagtgtttacatagataggtttctttctttctttttttttttttttaagattctatttatttattcatgagacccagaatgagagagagagaatgagagagagagagagagagagagaggcagagacacacaggcagagggagaaggaggctccatgcagggagccccacgtgggacttgacccagggtctccaggatcaggccctggactgaaggcggcgctaaactgctgagccacccgggctgccccatagataggtttctaaaggtgaatctggtttctctattagttaaaaacagaatcactaccatgataaagatttaagtaagtgagttgtaaaattctagatgtgtttaagaaagttcaagtaggccattaaatgttggcagaaatttgtggcatgctgtgatctttggcacacctctgacagatcacacttaaaatgtcacctatgaagtctaaatataaaacttcttgggaaagtgaagagatataatcaaactctccatagcttttcctaaacaagaagtgctgagagttgtgaccatgattttaatttcattcaatcaactataaaaatcaggaaaattggcaaaatttaggctgatttcataagggcacaaattgatagtcctctctgtattgggcctccagatttgaagtttacagccagggagaaactcagaacccttccagaatgcaatccaatatagattccaaagagttcagtgaaaatattcttaaaatgataaacttcaaatatcttagtgaccctgtaacctttgggcagagatacattgagttccatagaaggcagattgctgcacagattgctgtgctagtggtatctgcagacaacagagtaaacttcagcttttcaaacaccctgatcagaaagatgaaaaatatccttggtaagtatgacaatatccttaactgtgtctgattattacccccagacccaccaaaaaatgatctctaaaattgacagcagggtagtaatgaaagtttctctagattaagaagcctcatgcaaaaggaataaaaattcctcaaaagaagcgtctctggatcccagctgctatggaaagtctgaggttgagagttgtcttttattatcatctccaattcatttccccatctcaaacatggggagcattgcagatcatatattttgataatgtttatattataataatgctcaaaagcaacagggtcacagtgtcctgattttcaaaatagcacatgtggcaaacatgaaagaaacagctattaacttgcaaggcaattttgtttccactactcttcacagcatcaccccccaaaacaggtgccatcagtcagctcagtggcttaaaaagcctatacatagatatcctatagccacatgaaatcaccatttgttagagggtgccaattccaccgtggtaatcatggtagccatcagctgataataagtcaataatccctctagtaaaagctgaatgaacctgtgccacagccagccagccagactagcaccaggtcctgaagatgttgaagaatgcttcatgagcactgatgatgatgcttacctcttctgaaaatagcttccagaaccaatgaaacactgatttttatgtttaagaaactcaaaatctaccaagcaatataaataaaaaagaaaacatattagacatactctagtaaaaccataggatacctaacacaaagaaattttaaagcatcagaagtgggaggaatgcagtttatcttcaaaaagaagaaattagactaattgctgacttttcatcagcaaaaatggaaaccaaaaatagtacagtgatgttttcatgatgtttaataaaaataactgcccacctatgaattttatacttggtgactctatttttcaagaatgaggaaagcattttcagatgaacaaaaatcaagatcatttgccctcacatattttaatgaagaaaattataaaaatatgtacttcatgcagaaggaaggtaatcccagatacaaagtctggaatgaaatgaagaacaaagacagttagtaaatatatgagccatgctaacatatctcaatttataaaatcaaactaattatcctgtggagttttaaaataatatgtaatttaaataagaatatgtaaattgagagagagtataaagtgttaaatcacttcaacatctttgtattggttttcttcttttttttcaaaacagaaataattattatccatatcagctatcatgtcttccagagcagagaagaggctgattttatttatttagatgaaaaatactaacaccaaatcacacttaacaatgtaggcctaggctcagtctctctcttgctttcaatagtgagtaactaatggaatataatatgtggattcctgggatcaatcctgttcaaatcatgaagcaagaatgtacaaactagtaccagtagcagtaagtattgcactggtaattctagccaatgagagatatttggaacaaaagagtaagcaaatcccaaactcttaaactttcctttcctccttagagtaaccttttgaaaagtataataaaaattcaattaatttaatattaataaactgtatccaagtcatattgtaataagaaatattccaaatattatgaagaaattctactactgtattaaacaaaaatgtatttaattccaaataaggaaatcaaaacaggaactctctggcactctttctgggtatcaatatatatttaattttttttttaacatcttcgtttgtaatggtgctctggagtcacacactggactcttttttttcctgaagatttaatttaataccaagaatccattttaaaggtgattgaatatcatatctttatttatgataaagaatgttatctgtggtatggctggtaagagaatgggtgcaaggctcatcatcagtgaaaaattcaaagttattagaaatcaagcagggaagaaactctcaaatgtatggagaatgaagacaaactctcaaataacttctagaggcacagctcaggtgagacatgtacagaacatatatctgttcacagctgtgccatcaatactctgttcactgctgccaccctgtttcagactgtcaccaaattgagaactggcattcaaaagtggcaccaacctgacattttctcaattatgtataaagtactaaacatatataaaaaattttaaatgcataaaaataaaacagtatttttaaataaaaggccttggagaactgggaatatttttgtggatattggagcagataaaagaaggtaagtgtggaaaagggaggtaggaaagaaatatttccttgcgtataaatgttggagagagggggtgggagctgggggagaagctgagcatggtgttctatgataaagaacgttcatggggggatccctgggtggcgcagcggtttagcacctgcctttggcccagggcgtgatcctggagacccgggatcgaatcccacgtcgggctcccggtgcatggagcctgcttctccctctgcctgtgtttctgcctctctctctctctctctctctcactgtgtgcctatcataaaaaaaaaaaaaaaaaaggaacgttcatggttcatgggaagtagcatgcgtgaatcatagaagtaccataatatatggagaataaaccaaaatggtgccctaggccagttatcaaagtctagtcaaaaaataaagtaataattcagtagcaatattgaataaagttagtgaataatgtaaaaatgagaaagtattgaaataagattactgattactacaggactctcttcttttttctttagagagagagatggggcagagaaagagagagaattttaaacaggctccatgcccagtgcggagcctgactcagagcttgatcttacaactctaagatcatggtctgagccaaagtcaagggattgggcatagagattagcatgataacaataggaatggatctataggaatggacaatacgaataccatgcattttggggcagcttggtgactcagtggttgggcatctgcctttggctcaggtcgtgatcccagagtcctgggatcaagtcccacgtttggcttcccttagggagcctgcttctccctctgcctaattctctgcctctttctgtgtctctcatgaataaataaataagatctttaaaaaatgttttaaaaggataccgtgctttttttttattcccaggcatgcattagaaactagtatttggggtgcctgcaaggctcagctggttaagcatctgcctttggctcaggtcatgatctcagggtcctgggatggagctccaagttaagctccctgctcagcgggcagtctgttggtctttgtttctctgcccctccctctatttatgtgctctctctctctctctcaagtaaataaataaaatctttagaaactggtaattgatgaataaggaaagaacctgagtttttttccctaaagaatgtattttgctttccttttggaaataacacccaaaggatcagactttgtattggtgtaggtgttagcttgtgggtaagacacattggagaaagggaaagatagagagagagaagtatgctgaaaaatctccatcctttctcagataattgtttttctctgtatccaatggggataaagagtaaggcaacatcacttatttctagcagatccacctgactagaaggtcttctttaaagtctgaggtatagagaatccagaagtgggccctcaactttatggtcaactaatattcgacaaaggaggaaagactatccactggaaaaaagtctcttcaataaatggtgctgggaaaattggacatccacatacaaaagaatgaaactataccattctcttgcaccatacacaaagataaactcaaaatggatgaaagatcttaatgtgagacaagattccatcaaaatcctagagaagaacacaagcaacaccctttttgaacttggccacagcaacttcttgcaagatccatccatgaaggcaagggaaacaaaagcaaaaatgaactattgggacttcatcaagataagaagcttttgcacagcaaaggatacagtcaacaaaactaaaagacaatctacagaatgggagaagatatttgcaaatgacatatcagttaaaggactagtatccaagatctataaagaacttattaaactcagcagcaaagaaacaaacaatccaatcatgaaatgggcaaaagacatgaacagaaatctcacagaggaagacatagacatggccaacatgcacatgagaaaatgctccgcatcactggccatcagggaaatacaaatcaaaaccacaatgagatcccacctcacaccagtgagaatggggaaattaacaaggcaggaaacaacaaatgttggagaggatgtggagaaaggggaaccctcttgcactgttggtgggaatgtgaactggtgcagccactctggaaaactgtgtggaggttccccaaagagttaaaaatagatctgccttatgacccagcaattgcactgttggggatttaccccaaagatacagatccagtgaaacgccagaacacctgaaccccgatatttacagcagcaatgtccacagtagccaacctgcggaagagcctcagtgtccatcgaaagatgaatggataaagaagatgtggtctatgtatacaatggaatattactcagccattagaaacgacaaatacccaccatttgcttcgacgtggatagaactggagggtattatgctgagtgaaatgagtgaatcggagaaggacaaacattatatggtctcattcatttggggaatataaaaaatagtgaaagggaataaaggggaaaggagaaaaaatgagtgggaaatatcagaaagggagacagagcatgagagactcctaactctgggaaacgaacaaggggtggtagaaagggaggtgggcggggggtgggggtgactgggtgactggcactgagggggcacttgatgggatgagcactgggtgttattctatatgttgccaaattgaacaccaataaaaaataaattaaaaaaaataaagtctgaggtagaagtcaagggagggcagaatgactaagttagatgactattaaggataagacaagctgaacatttccttggatggaattatttaggacataattaggtggttagctaggaaaagatattgtggagtaaagcaaaatgtggagtgaggattggaggaactaggcatttagaatggcagagacacgatgcctgtttttttgtgcctatgtaggaagtccctgctatgattaaaaagcacaattaaaaagctctgatgttggcatctccctgctattcctgttgtaaaagagatgggggatgggaaggtactcagttggctgagggtctcattcttgatttcagctcaggtcatgatcttagggtcctggggtagagccccacatgggctccctactcagcagagtctgctggaggagtctctccctttccctctgcctctccctctgctcacaattctctctctaaaataaataaatttcaaaaataaaatgtataattcagtgtgttttgaaaaaagatggggactatgaaagaaatccataaccccaactacagttgcacagatagacaaagggggaagcaaatagggaattatttattttctaccaggcacttagttatggccttccagacacctgatttcattaattatccccataattaatttgcaataggtgtatcatatcaccttataccatcagtttactgctacatcaccagcacatttaagaatgctaccactcatagtactcaataaatagtgactactagaaggtcaggaaattaaatgttttacatttttcatactttttagtgaaatagaccacaatataaaaaagcgcataaagcaaaaatgtacaactcatttgattattataatgcaaacatccatggaacctccctagatcaagaaacagaacattgggccaacacccagaagcccatcatatgcctcttcacatccccactgagataactcactatccaaactggtacagcaatcacttcctggctttttgatatgccttcaccctgcgttatttatctctaaacatgtttagtagcagtatacaaattaacttctgtgtgctcattgttttcaactgagcagccaggaaaggatagtcttgtcaataaatgctgctgagccagttggaaatctttattaaaaaaatatatgaggggagtcggcgcgcggccaataaaaaaaaaatgaaatttcacacctctttcacaccatacacaaattaattccaattaagatatatttgtatatacaaaaagcaatgcaataaaaccttcagaagataatattagaggctctctttataaccttgaagttggaaataatgcctaacataggatccaaagctcactagccataaagaaaacaattagccagcagtcacaagtataacatttaaatgaagacagtaggaaattattgcacactactagagagtgtcatgggatacactaggaaaactcctgatgtagatcttcaacgagcagatgacaccgatgccagaagcctctcactagctgggtttcaatatttttggttaagaaaaagagaaataagtcgacaggggagcacaccctcagatactttggaaatcactgaagggaaaggggtggttaaatctgtgaaacaaggggatccctgggtggcggtttagcgcctgcctttggcccagggcgcgatcctagagacccgggatagagtcccatgtcgggctcccggtgcatggagcctgcttctctctctgcctgtgtctctgcctctctctctctctctctctctctctctgtgactatcttaaataaataaaaattaaaaaaaaaaatctgtgaaacaagatgacttttaggaaggtgatgaactgaaaagcaaagagggaaggagagagtggcatgtcagtggcaacctctctaattatcacttccaaagtcaaagaaggaaattcttcctcattatccaccttaatttctccttgatgcaatggtatcaactaaacaataaatgttacccaatcacctacaaatgtcaagcgttatgctaattactgtgtgaacaatgcaagcatggaatacaattggtgaaattcaaagagcaaatatttattgaccacttcctatgttcaaaggactgtgagaagggttaggaataccagataaagatctcaataaggtcaatatctaccagaatagaaacacacatagaacagaaactccatgagttggagactttatattctttgtgtaccatttcctcctcagtcttacagaaagtcctggttcaaagcaggtaatcataagtagttgccaaattaataagtaatatattaaggataaatataggcatttataaatcacaataaagatacaaatgggtgggcagccctgatggcgcagcggtttagcgctgcctgcagcccggggtgtgatcctggagacccgggatggagtcccacgtcgggcgtcctgcgtggagcctgcttctccctctgcctgtgtctctgcctctctctcgctctctgaatgaataaataaataaatctttaaaaaaaaaaaaaagatacaaatgggtataatttaaaagtaacaaaattttattttattattattttaagattttatttatttattcataagagacacagagagagaggcagagacataggcagaaggagcagcaggctccccatgggggactcaatcccaggatcctggaatcacaacctaagccaaaggcagactcaaccactgagccactaaggtgcccccaaaattttaacatagtagagagataggatatattcacagattttggaatatttagaggaaacttgaaaatttgcagaagtgagacttgaggcagaaaaggaagaggttgtgattcagaagaacagcaggggaaaaggaacaatcatgagccacaggagcaaaagcagtaccaagtggggtgacttaatgtaaggagcaactctgattggctggagtgaacattcagattaaagaacagtatgccataagagaagataggcagagaggacctgctgtagaagaggccttggaggctgggcagagcatttacttcttttgaaaggtgatgaaatgactcatactgaaatatattacatttataaatgcaaagcaacagaatcaactgttggtaacccacgtgtcttgtaggcataggaagaccatcaaaactaggaagattaacagtgagactagggggctggcattactgaaagtcttgtgtcttcacaaacgtgtacaaggtactcctatcagatgagtagggaaagaaaatgtaaagctttttagaactgtctcttttctttcaggagtagcatccagagactcagtccttgaacttcaagctgcttctctactctgtacccccaattttttcttttaggtcagttttctgtacaaagcactacttaaagttcctactactaatcaatttttttcctacaactgttgggtggaataacatgacttgtcttcaccaaataatgctacttcaatagctctagcactagtccagtttcaagatcttgtgagaaagtggagtaggggcaggtgagttacacaaggagaggaaggtccaacacctgaagtttgtggtaagaaacaggacattggcagtatggattgtcagagactctccatatttggttttcaagcacaatttagatgggtgtacagtgctattaatcaggatacttgttctttttcaggcatagttggaaagcccctggccagagttaaatggaaaggaaattgctgtggtgctagtgtgtctttgctggtaaaaaaaaaaaaaaaaaacaaaactctgtagtaaaaagaagattaaaaggagagagtaaggagggagtgaggatggggggagaaagagattaagggccatcacttcatttgctgatcatcaagagaaagtgcaggggtgatgatggaaaaggcaatcaatagttttgggccttgattaggcattttaaaattatcgcatttaatctttaaaaactctgcaaataaaaatttataccatttgcagaaatgttagtaggaatgtgggaattacagcttgatttcaaaaagaaaaaatgttctttttgggaaatataaatttagtacaactgtattagtactgcaatcatgcaaagcatttttcaaggtgctggcattacaaggatgaatgggatctgtcgaacttgtttcctaggagttcagaacctacataatcttgctattttatactgcaacaagaactgcaataaatttgtttatgacatacagtgagtaaatgggtagggctatgagtttttaatagtgggcaaaattgtttaagtgttttacaaacctataagaaccttaaaaattaaagactaagctctctctgtacatgaaataataagggaaagagactatatctcagattgattaaagaagcagaaggggcaaagaaaatataatgaaataatatgcagaacaacaaaagataaaagatgcaggcagggagaagagtcctgcctggtattagagaaaagtcttccttaaggaatgagagcagatatacagagtgggaccaccccaacaaagcaaaggaattgtgcaactgcagatagaaaaggaaacaaaccgaaaagtcgttttggcaattccagtgtagttacaaggctagaaagtgacagaatggagtttctggatttgtagaacactaaaattctcatagtcatgctagcaaataacatttgcttaagagaggaattcatcttctctctttttaaagcagcacctacagactcagccctcaaacctagaatctgagtcatcagctagctagtccaggttcaggttaatgccttcttgggaaggtattccaactcttgcactgaggcattttaagaaaggaaagtcatcctggaaatccccatccctttattgaccaataaggatagaaagtgaaacagcatcacttgtctccagcagacgtatctgcttcacaggtctgatctgattctaggttctagagagaaaatcaataggaagcaggatgactgatatgtggtgagaggattggctgaccacctagtttcaaggaaagaaatgatatgtcatgttggagagccaagaaactacattttataattgtgaagcagagtagagagtgaggatctaactatttagtgttgggtggtggaggggagggtacctgatatttttcatgcatctgttaaaagtccctgttcagtttaaaatagaaggaaatgggtatgacattgagcattccctgctagtgatatgtgagtacctgtggtggacaagtagaaaattgtgaaaaaaatccatgatcacctgctgattttcatatgacaatttgagggaaagtcacaatatcatatactaatatttgttccagcaaggcaggacttccagatatgttatttctcaattaactatcataacagacttgcatttatattaactgctcagtctccagaatagtccttttttttttcttagaatagttctttatattcaatatatggtgggtcaattaattaataaatggggatactaagaattagtgaatttaagagacataggatcataattattaggatccaatcccagttctgcctacgtctaaaacccatgaattaaaaagattatctgaggtcaaagtgtatctggaataaaacttgcatcttcattctatgaattttacacacttcaatttaatatttcttcttccagtatccctccaatacaaagcaatatttcgctttgtcagacttactctggaattcagttaggaaatatatattgcaaattagaaaagaattgtgttcattgtcatgagattagaattctggcaattgatctatatcttcatccatgatctactcttttaagcttccatttcttcatcactaaaattaaaagacggaattacatttaattccccgtgttaacacctacctggttcctggactacgatacctattaataaatatttaatttctatttcacttacattcatcatttcagtaacaaaataatcacataaaggggaaaggaaaatggcttaaaaactgacttgaaaaaaaaaactgacttcaacagaaaataaggataaattctttttttaaaaagatttatttactcaatcaagaggcaagatggtggaagagtagggtccccaagtcatctgtccccaccaaattacctagaaaaccttcaaatcatcctgaaaatctacgaattcggcctgagatttaaagagagaccagctggaatgctacagtgagaagagttcgcgcttctatcaaggtaggaagacgggggggggggggggggggggggggggaagaaataaaggaacaaaggcctccaagagggaggggccccgcgaggagccgggctgaggccggggcgagtgtccccaggacaggagagccccgtcccggagacgcaggagctgcaccgaccttcccgggggaaaggggctcgcagggaggtggagcaggacccaggagggcggggatgccctcgggctcccggggacactaacagacacctgcgccccgggacagtgcgcggagctccctaagggctgcagcgcgcacggcgggacccggagcagctcgggggggctcgggggcggctccgcggagggggctgcggggcgggagcagctcgggggggctcgggggcggctccgcggagggggctgcggggcgggagcagctcgggggggctcgggggcggctccgcggagggggctgcgggacgggagcagctcggggggctcgggggtggctccgcggagggggctgcagggcgggagcagctccgggggctcgggggcggctccgcggagggggctgcggggcgggaggagctcggaggggctcgggcggggactccgcagagggggctgcagggcgggagcagctcgggggggctcgggcggcggctccaccaatccaccagcgcaggctccggagcacagggcgccgggacacagcccaggatccggcctcccccgggacaggcggaggccaggagggcccaggacagcaaggacgctcctgccccgagctgagcagatcagcggccccgccccggagcctccaggccctgcagacggagagctctgtggttactgcgggggctgactccagggctccagagctggccccgccactgcggttgttgctcctggggcctcacggggtaaacaacccctactgagtcctgcaccgggcagcaagcagctccgccaagtgctaacacctgaaaatcagcacagcaggcccctcacccagaagaccagctagatggacaagttccaggggaagtcaagggacttaaagtatatagaatcagaagatactctcccgtggtttttttgtttgtttgtttgttttgctttttgatttgtttgcttcctccacccttttttttcctttctttctttttctttctctttttcttctttttttcctttttttcttccttctttcttttttctttttctcttttctttccttctttctctcctctctttttctccttttcccaatacaacttgtttttggccactctgcactgagcaaaatgactagaaggaaaacctcacctcaaaagaaacaatcagaaacagtcctctctcccacagagttacaaaatctggattacaattcaatgtcagaaagccaagtcagaagcactattatacagcaactggtggctctagaaaaaagcataaaggactcaagagacttcatgactgcagaatttagatccaatcaggcagaaattaaaaatcaattgaatgagatgcaatccaaactagaagtcctaacgacgagggttaacgaggtggaagaaccagtgagtgacatagaagacaagttgatggcaaagagggaaactgaggaaaaaagagacaaacaattaaaagaccatgaagacagattaagggaaataaacgacagcctgaggaagaaaaacctacttttaattgggattcccgagggcaccgaaagggccagagggccagaatatgtattcgaacaactcctagctgaaaactttcctaatctgagaagggaaacaggcattcagatgcaggaaatcgagagatccccccctaaaatcaataaaaaccgttcaacacctcgacatttaatagtgaagcttgcaaattccaaagataaagagaagatccttaaagcagcaagagactagaaatccctgacttttatggggaggagtattaggataacagcagacctcaccacagagacatggcaggccagaaagggctggcaggatatattcagggtcctaaatgagaagaacatgcaaccaagaatactttatccagcaaggctttcattcaaaatggaaggagagataaagagcttccaagacaggcaggaactgaaagaatatgtgacctccaaaccagctctgcaagaaattttaagggggactcttaaaagtcccctttaagaagaagttcagtggaacaatgcacaaaaacaaggactgaatagatatcatggtgacactaaactcatatctttcgatagtaactctgaacgtgaacgggcttaatgaccccatcaaaagacgcagggtttcagactggataaaaaagcaggacccatctatttgctgtctacaagagactcattttagacagaaggacacctacagcctgaaaataaaaggttggagaaccatttaccattcgaatggtcctcaaaagaaagcaggggtagccatccttatatcagataaactaaaatttaccccaaagactgtagtgagagatgaagagggacactatctcatacttaaaggatctatccaacaagaggacttaacaatcctcaatatatatgccccgaatgtgggagctgccaaatatttatatcaattaataaccaaactgaagaaatacttagataataatgcacttatacttggtgacttcagtctagctctttctatactcgataggccttctaagcacaacatctccaaagaaacgagaactttaaatgatacactggaccagatggatttcacagatatctacagaactttacatccaaactcaactgaatacattcttctcaagtgcacatggaactttctccagaatagaccacatactgggtcacaaatcgggtctgaaccggtaccaaaagattgggatcgtccccagcatattctcagaccataatgccttgaaattacaactaaatcacaacaagaagtttggaacgacctcaaacacgtggaggtgaaggaccatcctgctaaaagatgaaagggtcaaccaggaaattaaggaagaattaaaaagattcatggaaaataatgagaatgaagatacaaccattcaaaatctttgggatgcagcaaaagcagtcctaagggggaaatacatcgcaatacaagcatccattcaaaaactggaaagaactcaaatacaaaagctaaccttacatataaaggagctagagaaaaaacagcaaatagatcctacatccagcagaagaagagagttaataaagattcgagcagaactcaatgatattgagaccagaagaactgtggaacagatcaacagaaccaggagttggttctttgaaagaattaataagatagataaaccattagccagccatattaaaaagaagagagagaagactcaaattagtaaaatcatgaatgagaaaggagagatcactaccaacaccaaggaaatacaaacgattttaaaaacatattatgaactgctatacgccaataaattaggcaatctagaagaaatggacgcattcctggaaagccacaaactaccaaaactggaacaggaagaaatagaaaacctgaacaggccaataaccagggaggaaattgaagcagtcatcaaaaacctcccaagacacaaaagtccagggccagatggcttcccaggggaattctatcaaacgtttaaagaagaaaccatacctattctcctaaagctgtttggaaagatagaaagagatggagtacttccaaattcgttctataaggccagcatcaccttaattctaaaaccagacaaagaccccaccaaaaaggagaattacagaccaatatccctgatgaacatggatgcaaaaaatctcaacaagatactagccaataggatccaacaatacattaagaaaattattcaccatgaccaagtaggatttatccccgggacacaaggctggttcaacactcgtaaaacaatcaatgtgattcatcatatcagcaagagaaaaaacaagaaccatatgatcctctcattagatgcagagaaagcatttgacaaaatacagcatccattcctgatcaaaactcttcagagtgtagggatagagggaacattcctcgacatcttaaaagccatctacgaaaagcccacagcaaatatcattctcaatggggaagcactgggagcctttcccctaaaatcaggaacaagacagggatgtccactctcaccactgctattcaacatagtactggagtcctagcctcagcaatcagacaacaaaaagacattaaaggcattcaaattggcaaagaagaagtcaaactctccctcttcgccgatgacatgatactctacatagaaaacccaaaagcctccaccccaagattgctagaattcatacagcaatttggtagcgttgcaggatataaaatcaatgcccagaaatcagtggtatttctatacactaacaatgagactgaagaaagagaaattaaggagtcaatcccatttacaattgcacccaaaagcataagatacctaggaataaacctaaccaaagatgtaaaggatatataccctaaaaactatagaacacttctgaaagaaattgaggaagacacaaagagatggaaaaattccatgctcatggattggcagaattaatattgtgaaaatgtcaatgttacccagggcaatatacacgtttaatgcaatccctatcaaaataccatggactttcttcagagagttagaacaaactattttaagatttgtgtggaatagaaaagaccctgaatagccaggggaattttaaaaaagaaaaccatatctgggggcatcacaatgccagatttcaggttgtactacaaagctgtggtcatcaagatagtgtggtactggcacagaaacagacacagagattaatggaacagaatagagaacccagaagtggaccctcaactttatggtcaactaatattcgataaaggaggaaagactatccattggaagaaagacagtctcttcaataaatggtgctgggaaaattggacatccatatgcagaagaatgaaactagaccactctcttgcaccatacacaaagataaactcaaaatggatgaaagatcttaatgtgagacaagattccatcaaaatcctagagaacacaggcaataccctttttgaactcggccacagtaacttcttgcaagatacatccatgaaggcaaaagaaacaaaagcaaaaatgaactattgggacttcatcaagataagaagcttttgcacagcaaaggatacagtcaacaaaactaaaagacaatctacagaatgggagaagatatttgcaaataatgtatcagataaagggctagtttccaaaatctataaagaacttattaaactcaacaccaaagaaacaaacaatccaatcatgaaatgggcaagagacatgaacagaaatctcacagaggaagacatagacatggccaacatgcacatgagaaaatgttctgcatcacttgccatcaggtaaatacacatgaaaaccacagtgagagataccacgtcacactagtgaaaatggggaaaataaacaagacaggaaacaacaatgttggagaggatgtggagaaaggggaaccctcttgcactttggtgggaatgtgaactggtgcagccactctggaaaactgtgtggaggttcctcaaagagttaaaaatagacctgccctacgacccagcaactgcactgttggggatttatcccaaagatacagatgcaatgaaacgccgggacacctacaccccaatgtttatagcagcaatgtccacaatagccaaactgtggaaggagcctcggtgtccatcgaaagatgaatggataaagaagatgtggtttatgtacacaatggaatattactcagccattagaaatgacaaatacccaccatttgcttcaacgtggatggaactggagggtattatgctgagtgaaatgagtgaatcggagaaggacaaacagtatatggtctcattcatttggggaatataaataatagtgaaagggaatataagggaagggtgaagaaatgtgtgggaaatatcagaaagggagacagaacatgaagactcctctgggaaatgaactaggggtggtggaaggggaagagggtggggggtggaggtgaatgggtgtcgggcactgaggggggcacttgatgggatgagcactgggtgttattctgtatgttgttggtaaattgaacaccaataaaaaataaatttatttaaaaagataaaataaaacaatgacattttttaaaagttttatttatttatttatttatttatttatttatttatttatgatagacacaaagagagagagagagagaggcagagacacaggagaagggagaagcaggctccatcccaggagcctgatgtggactggatccgggttcccaggacccctccctgggccaaaggcaggcgctaaaccactgagccacccagggatcccaggataaattcttttttgagaacagatttatattttaccttttaaatttttttatttatttactttttaaattctagtataattaatgtacaattttgtatttgtttcaggtatacaatacagtgatttaacatttctatacattcattactcagtgctcatcacaataagtgtacctttagtatccttacctattttactcatccccatgctgacttcccctctagcaaccaccaatttgctctctatatttaagagtctgttttgtatatctgccccttcttttctttgttcacttgttttgtttcttatattacacatatgagtgaagtcttatggtatttgtctttctctgactgccttattcaaaaatgattaaatatttaaatgtgggacatgaaaccataaaattcctagaagaatcacagatggtaatctctgacatcagtcataggaacatttttctagctatgtctcttagatatggcaagggaaacaagagcaaaattaaactattggactataccaaaataaaaggctcttacacagcaaaagaaaccttcaacaaaacaaaaagacaacccaccaaatggaagaggatatttgcaaatgacatatcttataaaaggttagtacccaaaatatataaagaacttatacaactcaacaccaaaaaaccctcaaataatccaattaaaaactagacagaaaacaggaacaggcacttctccaaagaacacatacagatgaccaacaggcacatgaaatgatgctcaacatcaactcatcatcagagaaatacaaatcaaaactacaatgagatatcacctcaaatctgtcagaatacctaaaatcaacaatgcaacagttgctggtgaggatgtggagaaaaaggagctctcacatactgttgatggaaatgcaactggtgccatcaccatggaaaatagtatggaggctcctcaaaaactcaaaaatagaactaccatatggtgcaatagcactactgggtatttaccaaagaatacaaacacactaactcaaaaggatatttacaccccgatgttcattgcagcattatttacaatagccaaattatggaagcagcccaagtgtccattgatagatgagtggataaagaagaattatatatatacacagtatatacaatggaatatatatgtatatatattccaatatatataatggaatattattcagcataaagaagattgaaatcttcccatttgcaacaacatagatggagctagagggtataatgctaatagaaataagtcagtcagaggaagatttcactcatatgtggaattaaaaaaaaaaacaaataaaggagaaaaagagaagaaaaccaagaaatagacttttaactgtaaagaaaacataatgtttattacaggggaggtgggtgggagtatgggttaatacattaaggggattaagagtacatttatcatgatgaacactgggcaatgtatagaaatgttgaatccactatattgtacactagaaactaatataacacatatattaactatactgggaaaacaaaaacttaacaaaaaaataaaagttaaagatgagcagagaacaaaaacagacatttttctaaagaggacatgcagatggccagcaggcacatgaaaatgtgctcaatatcactagtcatcagggaaatgcaaatcaaaccacaatgagatatcacttcatacctgtcagaactgttaaaatcaaaaacacaagaaacagtgttggcaaggatgtggagagaaaaaataacccttgtgcactgttggtgggaatgcaaactggtacaaccattgtggaaaacagtatggaaattcttcaaaaagttaaaaaatagaatttccatatgatgcagcaattccacaagtgggtatttacccaaataaagaaaaaaaatttaattatctcagaagaaaataatttctcaatatggccaaacaatactaataaaaatattagtcctttttggattcttcttaaagtattaagagattaagagattaagattaagagatcttaatggcaggaataggatgttattgttaaactattcttggggtaactgtgctcattgtaattcaggagttagtgagtacactgctagcactctttgccttctaacatagaactgtgggacaggatcttcactcttttggtggaaaaaatatattttctaaattagacaaaaatctatgttagcataattttcatcactatgtattaactaactttccaatccattccctgatttactgatagctaccccctttgtaacatcatataaatacttctctgaaaacctggcatgggtacttgggtttctataacaggtggagatctgtatactattctaggcttgccagttccaaggctatggaggaaatccttgtttacatatgaaccacaagatcattctttttaaaaaaaaaaaaaatctatttatttattcatgaaagacacacagagagagacataggcagagggagaagcaggatccatgcaaggagcccgatgtgggactcgatccgggggtctccaggatcacaccttgggctgcaggcggcgctaaaccgctgtgccaccggggctgtcccacaagatcattcttaatggagacaggaatatccttaagtgggatttattgaagtttcctataggtaaccgtagattattggactatctgtcaagaaaggagaaaagtggagcaggatcgagtgctggaggtggatgccccgtgggctggcagcccgtgatgctaggcaccctgccgccccagcgcttaccgcacccaggccatgtcactctggcggttagggtccaactgagtggagaaggcaagatgatggaagagtaggggtcctcctttcacctggtccctcaaacttagctagataactttcaagccaccctgaacccctatgaattcaatctgaggtataaagaaaacagctggaacactgcagagagaaaagtgatgcttcctacaaggaaagagtgtggagaagagaaatggagggatatatcgggagataaagggcgggggaagggagccttcctaagcctctgcacaaaagcggtatagcactagggcttagtagggctttcctttagaaatctgctcctgagagagtcttccctgcctgaaaagtgcagagtcgtgacatagggcagaatcacaggaggggcagtgacatctcaatattcccagagacagagtaagaataggggcaccaaggagaaagctcaacttgtgccataaaccacaaacccctatcagatcatcagacggatagcatcctaggtcctggtaaaggactgggagtctgggagtggcgaagcggtgcatgctcgagctggtgaacgctctttgccccaggacctggcagcaggcaggagtgggctatcctctgtttgctctggcagaagtagagccagtgagcacgtaagacagtgaaagctctcccgctgtgaggcgcccttcaaattgtacaaatcagtacccccatgcctgcccccaggaggatctgagccagcgctgctaagagactgcagttccttacacgctggaagcgaagcgcttggctcccgggctagagatctggccacagctactttcttttctcctttccccctggagaggcctggcctcccggaacaaaggcctcacagggcagccagctcacactgagcccagctacctggccaggggagggacatcagggcccaggcccaggcagctgagaatcaacacagcaggcccctccccaagaagaccaacggaagagcagagaaagagcaagtttactaaccaagcagccctggaaagctccaggattgaggaaaaatagtgtatagaactctagggtttttttccttataattcgtttatctttcaggttaaagatttccaatagtctttcttttttcctaccctaactacaatatttcatcaactcttcatttttaagttttttttttccttttggacattcatatttttataattacatgtcatagatatattcttcatttttggcttcctttcaatgtattccatttcatgtttgtagatatgtactttttggagggttttggttttggttttggtttggtttataattttggaatttagtaccttctaacatagaccaaaatatactcagaaacacatggagcattgagttggtccactctatgagattatactccctcttccttcccattccacctctctcttttgtcttcttgtttttgtttttgttgttgctattgtttctctatacaagttttacttgtttatgtttttattttattattttagttaaaaaaattctttattggcgttcaatttgccaacatttagcattacacccagtgctcatccgaccaagtgcccccctcagtcatcccaaccccccgcccacctccctttccactaccccttgttcatttcctagagttaggagtctctcatgttttgtcaccctcactgatattttcactcattttctctcctttccctttatttcctttcactaatttttatattccccgaattaatgagaccatatgatgtttgtccttttctgattgacttatttcattcagcataataccctccagttccatccacatcgaagcaaatggtgggtatttgtcgtttctaatggttgagtaatattacattgtatacataaactacatcttctttatccattcatctctcggtggacactgaggctccttccacagtttggctattgtggacattgctgctataaacattggggtgcaggtgtcccagcatttcactgcatctgtatctttggagtaaatccccagcagtgcaattgctgggctgtagggcagatctatttttaactctttggggaacctccacaccgttttccagagtggctgcaccagttcacattcccaccaacagtgcaagagggttcccctttctccacatcctctccaacatttgtggtttcctgtctattaatgttcactattctcactggtgtgaggtgggatctcattgtggttttgatttgtattttcctgatggccagttatgcggagcattttctcatgtgcatgttggccatgtctatgtcttcctctgtgagatttctgttcatgtcttttgcccatttcatgattggattgtttgtttctttgctgtttagtttaaaaagttctctatagatcttggatactagtcctttaactgatatgtcatttgcaaatatcttctcccattctgtaggttgtcttttagttttgttgactgtttctttggctgtgcagaagcttcttatcttgatgaagtctcaataattcatttttgcttttgtttctcttgccttcatggatgtatcttgcaagaagttgctgtggccaagttcaaaaagggtgttgcttgtgttcttctctaggattttgatggaatcttgtctcacatttagatctttcatccatattgagtttatctttgtgtatggtgtaagagaatggtctaatttcattcttctgcatgtggatgtccagttttcccagcaccatttattgaagagactgtcttttttccagtggatagtctttcctgttttgtcgaatattagttgaccataaagttcagagtccacttctggattctctattctgttccattgatctatgtgtctgtttttgtgccggtaccacactgtcttgatgaccacagctttgtagtacaacctgaaatctggcattgtgatgcccccagctatggttttcttttttaaaattcccctggctattcggggtcttttctgattccacacagatcttaagatgatttcttccaactctctgaagaaaatccatggtattttcatagggattgcattaaatgtgtaaatttccctgggcaacattgacattttcacaatattaattcttccaatgcatgagcatggaatatttttccatctctttgtgtcttcctcaattcctttcagaagtgttctgtagtttttaaggtatagatccttagcctctttggttagatttattcctaggtatcttatgcttttgggtgaaattgtaaatgggattgacttcttaatttctctttcttcagactcattgttagtgtatagaaatgccactgatttctgggcgctgattttgtatcctgccacactgccgaattgctgtatgagttctagcaatcttggggtggagtctttagggttttctatgtacagtatcatgtcatctgcgaagagggagagtttgacttgaatttggaatttagcaccttctaacatacagaacgaaatatactcagaaccaagaggatcactgtcttagtctactctgtgagattatattctccttcccccactacttgctctcccccttttttaattttattatttttactgtttttttttttaatttgtttcttactttcttgctcttttttcttttttttttttcttttattttctggtttatgacctctttggaattatctagggtatattttactagggcatggttgatattttttactctactcactcatatagccattctgcactgcacaaaatgaatagaagaaagaattcaccacaaaagaaagaaccaaaagtaatagtctctgccacagatccagatggacatgaatttaagtaaaatgttggagaaagaattcaggattacaattataaagttactagttgggcttgaaaaaagcaggaaagactctacagaatctcttagtgcagaattgagatctcatcaggccaaaattaaaactactttaactgagatgcagtctaaattggatgctctaactgctatggttaatgaggcagaagagagagtgactgacatagaagacaagttgatggaaaggaaggaagctgaggaaaaaagaaaaacaattagagaccgcaaggagaaaatctgggagataagtgatagtttgagaaagcatattattcctgttaatgagattccagagagtatggagtgagagagagagaggaccagaaaatatatttgaatacattagagctgagaacttccctaatctggggaagaaaacaggcatttatattcaagagatagagaggatgcccccccttcaatcaacaaaagtgatcaacacccagacataaaatagtgaagcatgcagatttcagagataaagaaaaaaacctgaaagcagcttgagacaagagattcctaacatattggggggaaaatatacattaacagcaaacctatccacagagctctatcagtccagaaaggactgggataatatattcagagtactaaatgagaaacacatacagcccaggatactttatccagcaaggctgtcattcaaaatagaaggaagataaagagtatccaggatagacaaaaactgtaagaatatgtgatcaccaaatcagctctgaaagaaatattaagggggaccttgtaagacaagaggcagcccaaagaaacaatctgcagaaagtgggactgtataggtaatactacgacacaaattcatatctttcaatagttactctgaacgtgaatggtctaaatgctccagtatgaagacacagggtatcagactggatagaaaagcaagacctacccatatgctatctacaaggacaccttcagagtgaaaatgaagaaagagaaccatttaccatgaaaatggtcctcaaaagaaagcttgggtagcaatcctcatgtcagaaaaatttgattttaagccaaagactgtactaagagatgaagagggacactatatcaaaattaaagggtctgtccaacaagaagacctaacaaatgtgaatgtttataaccataatgtgggagcagccaattatatgaaccaattaataaccaaagagatacatacataataatacaattaatagtaggagatttcaatgctccacactcagtcaaggacaggtcttctaagcagaagatgaccacggaaacaagggccatgaatgacccactggaccaaacgggtttcacaaatatatacagaacattccatcccaatgcaactgaatatacattcttctcaagtgcacatggaactttctccaatatagaccacatactgggtcacaaatcaggtcactactcatacccaaagatggggattattccctgcatattttcagaccaaaatgctttaaaactagaactcaatcacaagaagaaatttggaaaggactcaaacacttagaggttaaagagcatcctactaaaagatgaagggtcaaccaggaaattagagaagaatttaaagatttatggaaactaacaaaaatgaaagtacaactgtttaaaatctttgggatacaggaaaggcagtcctaggagagaaatacatctcaatagaagcctccttcaaaaaattagaaaaattgcaaatgcgcaagctaactttacacctaaaggaactggagaaaaacagcaaataaaacctacaccaagcaggaaaagagaaataataaagaatagagcagaaatcaatgaaatagtgaccagaaaaactgtagaacagatcagtgaaaccaggacttgtcttcaaaagaattaataagatatataaacccctagccagacttattagaaaggaaagaaaaaagactgaaattaataaaatcatgaatgaaagaggagagatcacaaccaatactaaagaaatacaaacgatttttaaaacttattatgagctactatatgcgaagaaattaggcaatctggaggaaatggttgcattcctggaaacctacaaattaccaaaactgaaacaggaagaaatagaaaacctgaacaggccaataaccagtgaggaaattgaagcagtcatcaaaaacctcccaagacacaaaagtccagggccaggtggcttcccaggggaattctatcaatttctttaaaaaagaaataatacttactgtactaaagctgtttcaaaggatagaaatggaatacttccaaactcaaagacccccaccaaaagggagaattatagaacaatatatccctgatgaacatggatgccaaagttttcaccaagatactagccaaaaggatccaacaatacattaagagatcaattattcaccatgaccaagtgggatttatccttaggatgcaagattggttcaacatttgatagatcacattaataaaagaaaagacaagaaccatatgatcctctcaatagatgcagagaaaacatttgacaaaatacagcatccattcctgatcaaaactcttcagagtgtagggatagagggaacatacctcagcatcttaaaagccatctataaaaagcccacagcaaatatcattctcaatggggaaaaacagagagcctttcccctaagatcaggaacacaataggaatgtctactcttaccattgcctattcaacatagtactagaagtcctagcctcagtaatcagacaacaaaaagaagtaaaaggcattcgaattggcagagaaaaagtaaaattctccctctttgcagataataagatactgtacatttaaaaccctaaagaatcttccccaagattgctagaactcatacagcaattcggcaatgtggccgcatacaaaatcaatgcccagaaatcagtgacatttctatacactaacaacgagactgaagaaagagaaattaaggaattgattccatttacagttgcacccaaaagcgtaagatactaggaataaacctgacaaagagggtgaaggatctataaattaagactatacagcacttgggaaagaaattgagaaagatgcaaggagatggggaaaaaaataacatgctcatgaattggaagaataaatattgtgaaaatgtgtatgctaccctgagcaatctacacattcaatgcaatacttaacaaaataccatggactttcttcacagagttggaactaataatcctaagatttgtatggaactagaaaagaccccaaatagccaaggaaatgttgaaaaagaaaaacagagccagaagcatcacaatgtctggcttcaagctgtattacaaacctgtaatcatcaagacagtatggcaagggcacaaaaacagacacatcaatcaatggaacagaatagagaacccagaaatagaccctcaattctacggtcaactcatcttcaataaaacaggaaagcatatccactgaaaaaagacaatctcttcaataaatggcattggggaaattggacagccacatgcagaagaatgaaactggaccattctcttgcaccatacacaaagataaactcaaagtggatgaaagatctaaatatgagacaggactccatcaaaatcctacaggagaaaagacagcaaccttcttgatctcagccacagcaaactcttgtaagacatgtcggtaaaggcaaaggaaacaaaggcaaaaatgaactattgggacttcatcaagataaaaaaagcttctgcacagcaaaggaaacagtcaacaaaactaaaagacaacctacagaatgggagaaggtatttgcaaatgacatcagataaagcaatatgaaataaccaaattctatcatggaaaaggtttttagaaactttctcagaatctcttcaccatttgccaggaatgcatggaggcttcctaggaaggagatgttcacatcaaaatgctcagaataggaaaagacaacagtgcctttcaccgaattactggacacagtgcagcagatcgccccaaagcaacccagcaagctcagtcatgtccttcattttccccatgtgatatagtaagaactctcatattaaggaaccctcaataactgaggtaattagtagagaaatttatccttggctagggtgagcagagtctccagttgatcagaaggccggttttagtaaacaagggaatagagagatgcttcttctcagtgtccaagggtcagaaaggattcataatactacatttaaatttaaagagaggaactggaccagagcaaagagattacagaacttgcaagcttactggatgatgcctcagcaagagtgagaaagatacaataaactgtaatagagaaaatccaggacagctgcaagtgaacctttcatggtaccaatctcgtttaaagctccttaatgtcatgtatctttagtcagtaccagcaaagaacaggtatatgaatgggtagtgagatatactacctcactgataaatgtgcatagcaatacaaaatcctattcttagacttcagttcccacattgttcttgagtcagtagcaatggaaaccagcttggctcaaattaccagctcatgcatttagaaaatctataatacagggcaaatgagggctgatttatcagatttgccattggctaaatagtaagagtggagggagaggagggtgctggataatttagcccaggccctaaagagctatgtgttctagaaaacacacaggtgcccttactgatggccagcatgtattcatatgctcacctccagcagggaatcctttactgcccagaccctgagttgacagtcaacagggttcccatctctgttcaggggtgggctctacaggcccagcctcctggttaatgtagtctttacctttccagcacagtctctcatgttgatgttgagacagtggccctaaggctgtctggcccagagctgaacacactctcactattgggccaaacaatcccagattctacttattgtaatgggcatccccagtgcgtttagaaaattttgcagtgtggttattaatacgttggattcagaggcctggaagctgttctgtaaagtacagtgtttaactgaaaattgccttcacagttgggagtagtagcctacactccttggatgtctttacttacagtttgccctgatggtcctcacctcttttgtgaaacctttggagaatcgaccaaagactacgttattgtctaaaatttacattgaaaacatcagaaaaaacagtaacaccctggatggttgttggaagggagaagctgtctgggcataggaagtagttattagaccagggttgaggtagaagaggaaggatgatgacatcaatctttgcagaacccacatttacatgaaaccatgatacgctattaaatacatttcctcccagctcacaaggcaaatgagggaagccagcgtcatttgtctctggtttagtctcccactaaaccgtcaagaaggcacacccaaacctgtggtggcagacagagcaggggagagaaattctattaacatctcagttcagaaaaatcggtgtatgcatcggtgtatgctgtttatggagcatcgtgcagaatttctgaagttactgcccatgccgtccccactggaactcccctgcctttcttctctcccacgggatgtcatggtcccccagggatcatggccacaaagtttctgaacttggttgggctcccgcccactttgcaatccttgtatagatcttagtcatttctatctctcatttcccttcaccgtgtgcctttttgatccactcacttcagagaactaaaagaattactcctttgtacctcccagatacaaagaagaaaaacatgaacactcctcaaatccaataaagccttaaattcagaacccatggacactgctgttcctttccttgcaaaaggaaactttcagaagaaacgcccggtctgtagtgaaggcacagcaacttttgttgaaacttttgtgatcggcgggaagccttgactctggctgcagttagcaatggtctcagcacaggaacacttgttgggattttgatgaagctggagagtggtttggcctccaagagtttgaacctagtctagtctgactgaatacaacttcagaatcttcagctgagcatggatgtctccaaaacgtatcatctctttaaagaacccttagtaaatgacactagaactgaccaggagtgttcatccatgcacgcatgaacaaaatgctgtcaggtatgagaaacagagagaggaggaagagctcttttctacccccaaggtgcccaggcttatcgtggtaaaacactgccaggtggaggcactggaaggtgtacatatgtggcccgaggtctaagcaattcgttctttaggagaatttgtggcctagtgcctgtgaggggaagtgtgcacaaatgtccttctggttcacagtgcagcacagctgcccctctagcacatcaccctgaggttagattgcctgagtttgaattctggcaccactccttcctgatggtacagccttaggcaatgtccatgctacaatttccttgctggtataatgggaaagggagatgataataatatgcctacctcgtggtatcatgaagatgaagacagttagtataggaaaagcacttacaagagtgtctggcatatagaaagcactctgcaaacattatacattattatgattatgattatgattatgattattatcatcactatttttctcaattaattatcaggcctcgagggtaacctggcaatctgtctttattcactctctcactagcctggttgattgggatccaatacctcagggaggaaagtctccgtgtcaaaactaaaatagcctggctttctttacattaggtgggaagggaggaaggaagggaggaaggaaggaaggaaggaaggaaggaaggaaggaaggaaggaaggaaggaaggaaggaaggaaggaaagaaggaaggaaggaaggaaggaaggaaggaaggaaggaaggaaggaaggaaggaaggaaggaaggaaaggaaagaaggaaagaaggaaagaaggaagaaaggaaggagtagggaaggagtagggaacagctattcatgctttaggtcttgccattgccctgctcacctccaggaaactaaccagcaataggaaaggaaggcaaaaggctggatccacctcctccctccctccctccctgatttcctttgcaccacttacatgtcccagaaattgttggttgacgctgaaaactgcaagaatcaggcttacacctgattgattcaggtcaaatgtgtagttgatttgggggtttattggcagatcggtgagcagagggtatcctgaaactgagcagacataattaaataaaacttcctctgcgtttcgagaagtggaaacactttaagatgtcagtattaatagctgtcattaccctaccaacctatgattgtgagcccacccttggtttaagggcagacgtggttgtgacctagatcagaggggtaatatgtattccctcatctaattgctgagccctttgcttctctttgcatatggaacatttttatcaatagagaagcagagcattttgaaaggcacacccatattctacgtgctatcaccttttttttcacccaaatctgcaattctataacccagttctccctagccaggctctgctgacaatctttgtggaaattgggtttaagtgaaaccaaaataagacattgggtgcgttcctctcagacaaatgaaaaccgcatgggaggcagcatcattggtctctggcagactaagccacgaaggagcataagaaaaaaatgtttagatgtatgagaagaaaaacgtatccattaaaaagaaaacagtaaaaaaaaaaatactaagccatatatttaacaacgatgtaaagagtcatcagagaaaacattacaaaagtacaccaaagttggaaaagtactgcagaatacaatattcacagtgagaaatataatataaatatatgattataatgcagtttccatcaagatctacatgacaacctaaaaattaatgatgtgtttgtgaaagtcagtattcaaaatttttgtaaataaacaataaatgattaagtgtgtgtgtatctgacactatgccgtgtactttttataaataattagattttgtatccactgtactgcttaatttataaaaaatgctgcttctttttggaaatattttgttcttctatggagatgatttatcccatcgtctctgatttcagtattaataattttaatttagtgtaacatgaaaagttaagagaaaaaagataaatcaaatatcacataaaattctaaaattacaatgtaaatctaaaattctccaggaatgatgaacaagcagaactaaggaagaactcttgtcttttcctgatcttactacgtgccttataattactcttctcacccacactgtttaatctacctaagtatttccttctttcagcatgcatttcctttacctaaggagacaatactttctcccatactctgtagtctgaagagataagatatttcctcaagtcagtagttggaagagacacattgagtcacaaaggatcattccccatcaataaaaaaaggcaggtaggctttcatggtgtctacatttatcatccaaatgacatggacacttgagtggtaaatttcatcttaattctgattgtacacttacagtctcttgtcacctaacaacctgccagcaatggcagtggtgtatgccaaggtatttgagaaatacaaagctggataaaagccttctctaaagtctaggatgacctcagcacacttgtagcctggacagggaccctgagaaacatatctactctccccacactagaagcacatgctttcacctacaaaaatttgtttcatcattctcttagaacacttctgccgaggttttcaaagaacgaagctcttccagatttatgacagcttgtattcagttatccttcagataactgaacaacaatctctccttttcagctccaaaaatctgaatggctttaagaaacaagatatttcattacattcattatattaatccatggcaggagagtggggggagaatgagaaaataaattcccatattttcgaagtaatcacatcacctttttttttttaacatcatcttttttatgtgatttgggcagcaaggacactggatcactgctaattgggctgtatgctatcccatcatatccctaaaatttaagttctacaaggttttcttctttttgaaaattgttttggctattccagatcctttgcatatctatataaatgtatttagtccagctatttctaaagaggaaaaagacgtaggaggagggaggatcctgctaagatattgactctataaactaacttgagagaattaacttaactccataaactaagttaagagaattaacctcttaaaaatattggagatttaaattcattatatatatgtattatatatatatatattatatatatatatatatatatcaatgttttagatcttttaaattttactcagttgtattttgtgggtcttggattagaggtcttccatatttttcattataattatttctaattatattatgcattttgatagttatgattttggttgtttttccattttttaaattaagatatctatctatctatagatagagagagagaaattaaaattcaccctttttaattcacaattctgtgagttttgacaaatgtatataatcatgcaaccaccaccatgatcaagatgtaaaatagtttcatcactccaaaatatttccttgtgccccgttatagtcaacccctttccctatccttataatttgttttcgtaataatgtcatatccaattttccaacaccatttgttgaaaagtctatcctccattgaaatgtttttgcactatggcaaaaatcagttgactatatatatacgtggacctaatttgagactactctgttttattgatcaatatgcctgtcctttcaccaatacaatactgtcttactttagtgttagaataaatctggcaatcagggaacatgagtcttccaactctgttttgctttttcaataagccacacttattggagtttggctgatttcttctcttttatttgcatttccttataaattttagaattcctttgtcagtttgtacaaaaaaaatcctgctgagaatttaaatagaaagatattgaaactatagatcaaatgaagagattgacaccttaatagtattgagtcatcttatcaaggaacagggtattttaggtctttgatttcttttacgcagatttgtatattttatataagacttatagtgaaatattttatgggttttagtgctatgtaagtggtacttattttattcttaaattgtttaatgcaaataaatagaaataaaataaatatttgtatattgatcttcaaactctaaccttgctaaactcatctactgtagtaagttttatagattctttgggattttatacatagacaaataaatatattgtctatgaatagagatattttatttcttctcttccaatcggtatgccatttatttgtttgttttgttttgtttttctgaactgatacttaattggagtggtaagagcacgtatcctgttttgtggccatttttagcaggaagcatttagtctttcacttttaaccgtggtgttgattataggttttttgtagatgccatttatcaggctgaagacatgctgaaagtttttatcatgaaaagaggttaaactctgtcaagactctgtcagctctgctttttctgcatctattgacatgattacattgtggggtgtttttcatgctattaatatgataagttacatcatatcatgatgaacaaccttggcattaatggatgaatcccatttaattatgattaagcttttctgtaattattggattctatttgatagtatttaattgagaattggtatatataaataccaactattgtttgttcttgtaatatctgtcaggttttggtatcagggaaatattaacctcataaaatgagttgggatatgttttctcttttcttaaattatggagaagtcctatagaattggtattatttatttcttcagtgtttggtaaaatttgccagtggagtcatctggtcttagagttctctttattaaaagttttaaactaaaattttaatttgtttaatagattttaaagtattcctttttattttattttctattttttcattttatagtgaaatatatttgatgcataacattgtataagttgaaggtgtataacacgtttatttaacacatttacatatttaatgtgattgccattttatcaatatttagtatctatcacattataaaattatccttttttaatagttggaataataaagttctactctcttaataagtgttgaacttaaaaataaaacagctattttactggcaaaatgggtgtcttcaggaatagcagagaattgcaatttgggacaaaacaagatttggtaaaaactatcagctaggtcaacaaaaaaaggagaggaacattattttgtggaaaggaaggaggaagttgggaagggttgttttgaacaaaaatccattgaagaaaaggaagaatgtaggtgatgacactctttcattggctgagctgctgggatagtctgtttcttgtagaaggtgcaaggtacatcttttcctgttggagtctgtaattgattctctcctgttgagaatttggttatggtctataacaggcatcgggcggtactggtttgagcttccccttctatcctcccaactccattttagtgaggtttcctattattaatatttgcgtgttggatgattaaaatacaatattgttatctttattcaatataccatgcattagatttactacttgttgccagtttgtaccctaaacaacatttgtcctatgccgccactcttatcccctggttacatttttactcttcttatgagtaactttttagattccacgttgaagggatatcatacagtacttgctttctctgtctgacttatctcacttagtttaatttgctcaaggtccatccatgattttgcaaacggcaagatatctttctcatagctatagtattccatatgtatataatacacacacacacacacacacaaacacatcttctttatccattcatccattgatgggcactttggtggtttccatatcttggatattgtgaataatgctgcaataaatctggcaaacagaaattgaaattctgtttcaatttcctttgggtatatacacagaatggaattgctggatcatatgatagttctacatttaattttttgaggaaactccatattgttttcatagtggatgaaccaatatgtatttctaccaacaatatacaagggttcccttctgtccacatccttgccctcctgagcagggagcctgatgctgggctctatcccaggactctggtatcctgagcagaaggcagatgttcaactgccagtcactcaagcactccatcttttgtgtttctttttaaagattttatttatttattcataagagacatagagagagagaggcacagacacaggcacaggcagagggagaagcaggctccatgcagggagccaggtctccaggatcacaccctgggatcacaccctgggctgaaggtggcgctaaaccactgagccaccctggcttgccagatcttttgtgttcttgatgacagccattccagcatatgtaagatgatatcttaattgtggtgttttttttttttaatttttatttatttatgatagtcacagagagagagagacagagagaggcagagatataggcagagggagaagcaggctccatgcaccgggagcccgatgtgggacttgatcccgggtctccaggatcgcgccctgggacaaaggcaggcgctaaaccgctgcgccatccagggttcccttaagtgtggttttgatttgcttttccctaatgattagtgatgctgagcattttttcatgtacccattagacatttggatggcttctttagaaaatgtctatttaattcctctgctcacttttaaatcgaattgacaatttcgttattgagttttctgaattctttatatattttggcattaactccttttttaaaaagatttatttatttatttatttatttatttatttatttatttattcatgagagacacacactgagagaggcagagacataggcagagggagaagcaggctcctcacagggagccagatgctggactccatcccggatcctgggatcacaacctgagtcaaaggcaggcacccaaccactgagccacccaggcatcctggcattaactccttatttgatatatgatttacttacatttttcctgctctgatattgccttttcattctgttcatggtttcctttcctgtgcagaagtttttcagtttgatgtagtcccattttgttgattgttgtttttgttgtttgtgtttgagatgtcatatccaaacacatattgccaaggcaaatggcaagaacattttcccctatattcttctagggctttccatatatttttcttctgttccttactggttaaattctctgtgatccaagaaaatatatacactgtataaattcaatattttaacatttctgaggtgtgttcttttgtcagaatatggtttatcttgagagtattccacacccatttgaaaaaaaacatgtatttttgatgtgatgtggaggcggagaaaattaaggccattccactttaagttcagcgttagcacaagtacagccatcccaggccgctgtgaataagagctgaaatttacttacttacttacttacttcagttacaggaaaaaaacagtttacagcttaacgccctagaaagcccctattagaatgagaacagagcccaagccaagggctggaagccccatattagaattaaaacagagcccaatgcccttgaaaaccccatatcagaatgtaaacagaatttgagaaattcctcccccccttctggaggccccctagaccagcccataaaactaagctgaaacgcacttcggggggccaagtccctgctcctctgtgtcgggtatacatggacccaagctagagcttgcaaataaaccctcatgtgtttgcatcggtgtcagctccttggtggtttctgggattcgcaatcttgggcacaacagtgggtaaagtgttctatagatgtactcaagttggttgatagtactgctcagctactccatagctttactgactttctgtttaatttttctatcaaatactcaaaaatgagtgtagagcctccaaccataattttggacttttctttttctatcagcttttgtctctatatattgaaactgtcattaaatatacactaacttagaattgttatgtctttttggagaaataacccctttatcattaagggctccctctatccctcataatattccttgttctgacatctacgttttctgatattgacataattattccagttttctttggattttgtttacatggtataacttttacttttaatgtggctatgtggttatatgtggctataaatgggttacttataaacagatgatggtttgatcgcaccatttttattcattcccataacctatcattgaatatatgtttataccaagtatatttaatacaattattaaaatgattggattatttttgctaaatattttctattaattatattagatatgtgctcactttttaatcttttcctgcttacttttgggttagcagttgccgtacgatttactgcatataaatatagtctgtgttcaaattctaattcaagaacttagatcagtgtactctaaatttccctccccacttttttgtgcaactgttatcatatatgaagtggcaaaaaaaggcaaaagaaaaacttaaatttccttccttcctacagcccattgacaagttcttacaacagcccaagtgatcttcctccgggagctcagctacctgaatcaatgctgacactttgctaagggcaaaggcaaacttagcaaaccgccatttagcgctgaaaatgtcttaagaattctttcttggctgttggctccaaactctaacatttccacatcaatatactttactttttcatatcccataaaaacacaatgcattgctactatttttgctttacagagtctgttaccttatacaacaatgattcccccaagtgacatttgacgatgtctggagatactttctggtgtcacaactgggcggtaggctactgatatctatcgggcagagggcaggaatgttgctaaacagcctacagtgagcaggaaagattcctacaaaaagggattatccatataactgtaacaaaacctacaaacttacagttataaaataaataagtcatcggatataatgtatagcatggtgactacagttaatcatttattcattaactgtaaatagtaaacttagtattatcaatagttaacgatgtattattgacgtggagaacaatggcaaaagaaatgtagctaaaattaaatctccttataatttgcagcccattgacaaatacttgagggaggtagaataaaactctcctccaggactcccaatcctaatgttaatgccttctagagaaaaacaacatctccagcatgaggatagtcaggcttccaggatcttataagtcttctttaacatatgaaaatcctttttaaaacttcccttgtctttatctcccccaactccaaagtgtctagtcagtcactcctcccccttatgatgcagctctctctacccagaggtcctattcgatgtgatattcaaaaaaggttttttgcaccaaaaagtctcaagaatttttttttttttttttggtctttggttcctaaccttaccaacctcaaaccacagcattattaccaatgtattgatattatcaatattatcaagagttaactattaatagttaacaaataaatgtatatttgaagaagatatttgaaaatgacgtatcagataaagggctagtttccaagatctataaagaacttattaaactcaacaccaaagaaacaaacaatccaatcatgaaatgggcaaaagacatgaacagaaatctcacagaggaagacatagacatggccaacatgcacatgagaaaatgctctgcatcacttgccatcagggaaatacaaatcaaaaccacaatagataccacctcacaccagtgagaatggggaaaattaacaaggcaggaaaccacaaatgttggagaggatgcggagaaagggaaccctcttgcactgttggtgggaatgtgacctggtgcagctactctggaaaactgtgtggaggttcctcaaagagtcaaaaatagacctgccctacgacccagcaattgcactgcgggggatttaccccaaagatgcagatgcaattaaacgccgggacacctgcaccccaatgtttatagcagcaatgtccacaatagccgaactgtggaaggagccttggtgtccatcgaaagatgaatggataaagaagatgtggtttatgtatacaatggaatattcctcagccattagaaatgacaaatacccaccatttgcttcaacgtggatggaactggagggcattatgctgagtgaaatgagtgaatcggagaaggacaaacattatatggtctcattcatttggggaatataaataatagtgaaagaatagaagggaagggagaagaaatgggtaggaaatatcagaaagggagacagaacatgaagactcctaactctgggaaacgacctaggggtggtggaagggaggagggcagggggtggaggtgactgggtggcaggtactgagggggtgcacttgatgggatgagcactgggtgttattctgtatgttggcaaattgaaccccaataaaaaaataaatttattattaaaaaatgtatatttgaaagttgctaagagaatgaatcttaaaagttctcatcataagaaaagaatgtataattaggtatgctgatggacattaactagacttactgtggtgatcattccacaatgtatacaatatcaaatcattatgctatacaactgaagctaatataatgctatgtgtcaattatatatcggtaaaaaaaaataataatcctgctcaagataacaatagttctatggttgagaaacttttttttaatgagaaaagaaagaaaagatgatttttctacctaaccttgatttatgccttttccaatgcttttcacttctttgtatgaaccaggtttctgtctgatattaaatttctaacacatgaaggccttctgttatagaggtttgcaaaaattctgtggacttcaatcttcctgcatctcaaaggtaagaaggaatgcatgactctgaagtgcacagggtgaaagaagagactgaatgggttttgggttcattctctccaccttctctctctcttcagagcacactccttaaagccctctcaaatctatcatctctcagatgcatgacacatcttttcttttaatgagatggtgttttgtgcctgcctcaggctttccataaacaatgttgttggaatcaactcctggattcttaagaagatccaagatgtcctcagcaatacccaatgggaaactttgaaagagacaaggcttattacttacaaatcttggaaattacacagcacgcctggggccgtactgtgaagtcatgggtggggatggggaggagcaaacctaggtcctgcctttactgaagctgagagtaggagcccagaggtttgaaaatccgcttcaggttggtgaatttaaaacatcagaggagaaattaaggcataggaagagaaaaaatgaaggagcagggagtcagttacctaaatcgactagatctctaaaacaaacaaaataatcagagtggggcagttggctccttctctagtcttttggctggcagcctgttgattttaattagcctttgaagtagatgcttctttgaagtggatgcttccccaatcaggcaccattaggacaatcccattaccaaaaaaaaagaaaaccaatagccaaggtttatactacagatagttttagagaaatactctagtaaaaatatttgtaaccaattccattgttgtaaatacgattttataagataccactttgaagtatttttcaaaattccaaaatttacactcatagggattacttttcctcaatattgtcgattattagaacagtagaattctacttgtgctatcatctatatttttaaattctggttcaatcccaatttaaaactttcgaggcaaaatgttttaaatatatgtgctgacatctgatttttttaaatgtcatttaaaataaataattatatttaaaatttcatttgagtcatttgcatttgatttgctgagtaatgataagtatttctgtataatgaatgctcatgataaatgatatgacaaaaaaaaaaaggcaaaagaaataattaaatctccttattttctacagtccattcacaagtccttgaaacaggtaaagtgaccatcctgtgggagctaggtagcatagatgttgacactttgctaagacctaaaggcaatcttagcctgaccccgcagggtccagtgaatctactttaaagggcttctatgttaaaggaacttctcttcctttggaagctccctttatctgctcctaccaacaccatcccacctgcccagataatgttaggaatcatcctccaagcatataatccactgatatacgtggacctggagacgtggttgtggagaccacgaagggtctcctgactgaggattcactcaacagtagtaaatgacgttttcttaacaagaaccagtcccctcaagagtcgggaaagctgtttccaaatcccctggaggcttgtgctgtccctaaccccctcccaacttgaaatgatatcatccacactcctcaccaccccagtgcagctcctttctgcccatgggtcctgtccccgtgctttaataaaaatacctttctgcacacaagacatctcaagcattcttttctcgccatcttatcagaaccccacctcttcaaactacatcaataacctattacaataggagagttcttggaaagagaaccaatcaccgctggacctgaagaacgtcatctgtctctaggcaatcagtttctagcctcctgaattaagagcttccattcaaaaggcacttgtggattatagaccctagccctagcacacaggcctcatcaaatgacctattcagctgaactgaagagttcccttgagcaatagtgaaatctctgcccttggaagcaatgtttcaggtttttcagcaagtaaagagagaaagtaattagttcatacatacaggagttgttggtggcaaaggataggtggcagtgatattaaatgaaaaacagaaaaattatctttgcaatgtccatctgcttcattaatgtggtgcctaaattgagtgtctctccctcagatggggccctgaaatgtggtgcaacaacccagtggaagcctgtggctagggaggtgaaagaattcacctgaggcaaaagaaagaagaaagtttattgaatacaccacaagggagcagcagggggacctgctctcagaggagaggctaactgcaaggagcagagggtgggggcagtgttctaagggggatgaggaggaggtatggcaatctatggaactccccctattttggtaatggcgcctggttgtaagtagcccattggtcagttagagcctatggacactttgaggtgggtaccctgatggatctgtttgtattccatccctcaagcttgtttgcctaagaacagcctccaaaataaactctgtcatttgagaggccatgtgactggataatagtacacaggtctttgcatcagactgtgcttggtgaccataaggaagtcacttataattctcaaagtttctgtgctttcatctgtaaatcctaaaaggtttttggtgagaaaatatcatagcatctagtgcatgttggaattcaacagttcttagttcccatctcctttgagaaaggtatggggagaaactaaaatttagtgggtaaatgggtgggattcatttcatatgtggaagcacaagaactctcacatgcaaaatgtattgatgttttattctccaacaccagagaacatttgtgctaagttgaaaaaaatgatcctaaattctttgcagctcattctattaagaagtgtaacattcgggcgcctggggggctcagcgattgagtgtctgcctttggatgaagtcttgatcctggagtcctgggatccagtcacacttctggctcccctagaggagcctgcttctccctctgcctgtgtctctgcctctctctctgtgtctctcatgaataaaaaatacaatcttaaaaagaaaaaatatgcaacattaactcacctcttgaatgacatagctctgtgacttgttttgactactagaatgtaggggaagtggtgttgtgagtctaaatttaggctgaagaagccctgcagcttctctcttggactagggagtcttcccataccttgtgggtaagtgtaagccactctgctggatgatgagcccaaatggagtggcccagtagactgggctgaagcagttgatgccacagacatgtaaacacctgaagacaagggagctcacccaggacacagagtgccctgtgggcgtgacacaattttctgtcttacagaatcctgagaaaatactaaaacattatctgaaatcgttgcattttggagtagggtattatatagaaaaagctgactgatacaatatccttcaaagaaaattctatatcctagtgatctcttggtgctcccttgcttaacaggctctcacaaacctacactgccatagggggaagatgggatgatgagggaaaagctataagccatcgctggcctagaacgattaatctctgtcagtatacagttgtcatcatttgggagtattttccatgtgcacatactagagtgtatttaaaccttataatttgtacttctttataatttcatttcatcatataactatcacataatggttttcatcgcattttatagaaaagtacactaaagcttgtatattctgagtgacttacccaaggtgatacagctgataaagtcaaaagtagtttacaataaaagtaaacatttatttgatgaccaagtccaccttcttcttacttttgcttcactggacttggttgattgctgtgaggcatctctaattactgcaagacgggagaggctttggcctttgtagtacaattaaccgatgcataatgattgacattgtagcagggcaaaagagttgaaagtcagaactaaagaatttgaaaatacacaagtccttagaaaatgttatatatattaatgagaactaacctacattttgtctaaataatttcttagagggcacccaatgatgtaagttataatgactcttccatttatcttgacaattttaagttaaatcaatgcaggaaatagtgatttttgaggaaattatgagacaaagtaatattttaaactccatattttatttctaccatgaattaatttgtctttcagacagagctaagaagttagtttgtgtcaaaaatgacacatcattcttctgaatctaattctcgaataattttacctgatgtcaaaattatgacctgaagacagaagtgactggaacaggttcattgtgtgactgcaggaggaaatgagacacagagtctggttacaggcagagctcatcttcgcctagttaacgacatgggcttgcctgaacttctccatcccacaggatttgagatctgcagctagaccttggaacttcccgtccaagatgcaattctgatccacatgattagcaccctaacttcctaatctgagttaaattttctttaaagatgatactagtaggtaatattctggagccttgtcaagaatggttttgtccatctgtcacagtcttaagtaattttggcaaagaaatagcaaagtttcaagacagcgaaagtaaaaccaatgaatcaaggaagtagaaattagtagaaatttcttgtgcacaagtcaaaagacagtttgcacaccagaagtatttaaaccacaaggtgcaaggctcagggatagcttattataaggtagctatgtcatgagaaagcagtgactgcttaatcttcacaaggattggctacaatattcagttttcagtggttacctcatatcaaccatgggaaagagttcaatttcatttgtcctttccagaggctgaagcaagaaatgatccaattcaagatgaccttgcaaaataagctgaattactgttgtttgtacgattaaacttgtgccttccaaaggtacaagcaagacatgatcgggttcaagttagccttgcaaaataagccaaattaagcttcgtttgtaaaagttttgaggctggatgccatttgtttctgattttaacagtacagggcaggtaagtctggatccaagaagagcccagaaacatggtatctcctgcacagaaagaaggaggctgcatagtaaatgaagcatgcctcagtgaaacctcaaatcccgaatgatccataaaggcacagacttgaaagaataaatccaccgtagggtcaaatatctatcctaattatgttaggacctgtattctgaatccacacaggaaactccctcccctacaaagactcatgagtgacccttgtcattctgcagctctgcactcactagctgtgggaccgtgagcaaattccttcacctttctgaaactcaatatccttcttgtaacttgggggtgatattcatgtactacaggtatagtgggaaacccaggaatttttcattccaagtacagtatatatatatatatattcctcacagcgctcagatgagatgctgtcaatgcctccagccaaagaccatcaggagcacacctgagaatgaacaagttggtttaattgttcattgtcatgagggagaaaattcaccatggagaaaaacggggctctcaggctcatctctgctttttttttttttttatcctaattaaagtctgtttcatgcccagcatggagtccaaaacggggcttgatttcacaaccctgagatcaagacctgagctaagatcaagagccagacgtttaatccactgagccatctgggtgcccacatctctgttcttaagactttacaactggttggtttggagtcatccagattatctaggaagacctcccttgctttacatcaactatttattttaatcacatctacaaaatattttcagagcaattacaacattaatgtgtgattgaataactgaggactatagcttatcaacacatgaaaccaacaatttgactgctgtaaggtttgggtttgtgttaggtgattttgaggagaatataagatagagggactctgctcttagttggttgtcaggcaggaggattgcttggtctttttgtggcctggacaatatttgtattttgtctatgttcagacatagttactgactggccttgtttctctttatccatcatggtcgtcacagagtggcttacactgctgttctatgacatttttatgttcaccaggaaaacaccagaacccggctgtgggtagcacacctggttactagtaccaagtagctcccagatgccagagcttttcctgtcccagtcttcctatcatgtctgtcaatacagggtatgatagagtactgagcaatagaaggccatccaacaggcacaaagtgattgattctaagtggaagcccctagtatcttgtagcttccatacctctcagaagaagagaggtattcctctctattccatatttctcagaagaaaatcggttcttctggaaaaagaaggactaaggactgcctttgtcttcagctcaattcctagtccctcacaattatctggaatacgtagcaggataaagaatatgaaaacttccaggatgtcagggaaggaaatcaatttctaaatcacagcagttcccctcattctaccctcaacatttgacttacattcttaaatgtaaaaaaaaaaaaaaaaaaattgaaaacttaaaaataatacagtgaagcagctgaagcagtctttaatgcaatcaatgtccccaacttgcctttaaatgtaggcaggcaacactgaaacacagagcacaaagaacgctcagggtagggaaaccatgacagtgaaaaatgatgcaattactgtaggcagcattaatgaccttatgagttcttttatcgtcccagatgcaaatactggagcttttgagaccataagaggaatttaacaggaattacatatgtagtaaagcaaaggtaatccttggttaccatcagaagaaatatcctggtagataaatcaaaatttggaaaattttatatgcactatggaagcaaaaaaaaaattacatgtggaggccaggaaaagggaaggagttaaggattgccaaggaggggaatcaatttataggagaatttttggaggctgtaacccagaagagcctgaagaaaaccatgtaagtgattatgttatctatacatgaggctactcagaaattccgcccctcttgttgccaccaacaagcatacacatccatagaaagattgattgagtgagcctcctcctgtcctaggtaattcccccaggtccactctccatgcaggctacctcagaacaaggggatttcccagtatcttctggcttcttagtacaaactcttcaactggcaacagcagtgtcaccataaggcatttttctgattggccagaacctgacctggcaggttttggtttgggtgtctttagattcccctttctgttgggtcctcaccctagttctacaattcagaacagcaagtgtggagaccgcacggagaagaggatgatcctaaacagagttctgattctggggaccctcatcctgactattatgatgagcccctctggaggtgaagagattgtgggtgagtgcacacctgagggatatggggactagactagggaaaaggaattggaaggggaaaaagagagaatggcataaaatagtggagactcctcaaaggtgttctcaatattaagcaattctaaaatttttaatcattcttccttcaggaaactagagacccaacccactgtctttgctccctgtgatgttgcagagttcatcaaggatattattccatttctaatctcagatccagtgaatataggctagagagcttgatggcattcattcatgattaccttaaagtatagggatgtttccatgttttgttttgttactaaaaccaaatttgttttgttactaaaaagtcatgaactattgctcccaaatgtttctgaaaacattttgaaactttctacatgttttttctatagtcttacttggggtaaaaagtttcatgaattatgtatactatgtagatataaggaagggtatcctcttctttgactcaaatttacacacattttcatgctgggaactggcatgaggggagtgggtatacaagcccagctgaatacctttagacaagtcattcaaccacatgacctcatatatgtcattcaggaataataattaaatcaaatatgtatttagaaatatttttccaataatgtaaacatatccatgtcaatgatcatacttgtttcttaactgtttctattacaggtgtgagttaattttttaatttaatttaattctaggatggttaacctatacgtttctagtgtacagtatagtgattcaacaattctatacattactcagtgctcatcaagataaatgtactttttttcttttaaagatttttatttatttatgagaaacacagagagagaggcagagacatagacagagggagaagcaggctccctgtggggagcctgatgcaagactcaatctcaggaccccaagattatgatctgagctgaaggcagacgctcaaccaatgagccaccacccatgtgcctccaagataaatgtattcttaatcccctaacctgtttcagccatgccccccagtcacttatcctccggtaaacaacagtttgttccctacaattaagagtgtatttttgtttcttttgtttctttgtttctttgttttctttcttaaattccacacatcactgaaattatgatagttgtctttctctgaatgtttatttcgcttaccattacacgctctagctcctaccacattgtgcaaaaggcaagatttcattctttttatgactgaaaaatattccattgtacatatatatcatatcttctacaaagagtaggtttgtaacaatcaaagtagaaaaaccaagcagccttaagaggggaagtgaaatggagcatactctaattttcaacatctttgttagccatgagtgttcccatcctaatttaatttggtcagggaagtttgcctcactttgccagagaacttctaatttccttcttcaacatcatgccagaacatcttggtcaggctcaacttatccagtaagcacagtgccaagggcctatgatgcttctagggcaccataaaatgttttagtttcttctaaaattagaagaaatgaacttatgaggtagaggaaaatgttttaatttttaattcaacctggattatatttatctttataccaatgcagtcacaaagtgtgatttctaatattttatgaggaaagggacccaatagtgattaggctcacgagtcatacgacagccttgaccactgctgattaagttccgtatggtttgactagctctgtgtctatcaacctccactcacccaaatgtctgtgatctttgagaatagcaattgatattcaatacacacttttgagcaaacagtgagattaattttggggattcaaagatgaaggaaagcagaaggaatatcgctgagcagaactatggacccagctgaggctgaaaatacagaagtgaatcagttccagtcagccatgtagtgtgatgttcatcaacaaatggtgccttggacaagcaccaaatggaaagaataattgcatatactcatgtttgaaaaaggaaccaagggaaccaaggataaaggctagaggatgcagagggtttgatggagggcctttaagtaatcaccaaggaggggggcgggtcatgctgggcaaggaagagagttggatgaggcatagataaatctggaaagcaagacattgggatggaggcgttggaggttatagtgaagccaaaaaaatgttcaatgagactaattaactgaaatgttgctaaccaaacagaaacttccaaaaggaattggaggtacccaggaagtctgaaaagatagctttgtttcaaggagacacacccctaaaaaggccaaggaacatacaagaagaatgtgctttggtttgactggcagatgagatatttgcagaggaagtgggagcataagactgctgctgttccctgcaggactcaccacagcgtactgtatttgttcctgtactcacttgactctcccaccacgcaataaactccttgaagacagaaaccatgctgatgggtgtttgactccctgctcctcatgatgtctgacatcttgctgatgttcagtaaatgaggaagagcataaggaggaaatgataaaaaagctcacatatctctttacaaaattttctagttaggctcaccgggtggagtcatactgctgccattctactttggcatccttgcaaaatgtactgtccatttgaagagaagggccacagtttaccaggagtcctaaagtgatagaaatgcaactcagaattaggttagggggttacaagggaaaaaaaccccacgagggatggggagtgacagaaatctaaaatctaatgaatgttccattttgtacttctgatgaatcaagtgctcccctctgaggattaccattgttaacaagagaacttggtggctcctgggtggctccattggttaagtgtctgcctttggctcaggtcatgatcccagagtcctgggacagagccccaagttgggctacctgtggggagcatgtttcttcctttccctctgctgcctcctctgcttatgctctctccctctgtcaaataaataaataaaatcttttttaaaaaggaaccagagaccttaggagtattgtttattttttataaactttttaacaccgttgctgtccttgtcatactctttcttataccctaaaatagttaagaaactcttttagaagaatacaatccttcgtgctttttttgacaaaataagaagaagcagaagaaggcgcaggagagaggaggaagaaggaaggaaggaagcattacctctgcagaaaatattctgctctgaaccagtcctggggggagagcaatcaatgtatgtgttattaactgatgaaggaattaagagataaaactgatgaagcagagagaagttaagtgaatttctgataaaggaagctatagccatgataatttattcattccttctttcatttcattgtaatatttatcataagtctactgcgtaccaggtgctgagctacacacacgggaagagcagcagcaagactgttgtaattgtgctctcacggagcatacacgatagtggaaaagcagagcgtattctgactggacaactaccaacacggagagagagggggcaggtgctgggaaacgtgcctaaagactgtgccaaggatgaagctcgtaatatttgtttgcccacagtttgttctgtcacttggttgaataaggttcttttctccctctgttttctgcttcctgctcctcacccctgctgctcagctgaccatgttgcctactacggcataaatgtctaccagtcttacggtccctctggccagtacacccatgaatttgatggcgatgaggagttctacgtggacctggagaagaaggaaactgtctggcggctgcctgtgtttagcacatttacaagttttgacccacagggtgcactgagaaacttggctataacaaaacaaaacttgaacatcatgactaaaaggtccaacaaaactgctgctaccaatggtatgtgtctaccattctgcctctcttcactgaatctgtccccacatcccagctctctttcccttcctccctagcatagatactcttcactgttttccaaggatatttccccagatcttctcatagtaattactgaaccctcatcctcccccatctgaaaactgaaatattgccatgtaatgcaagaatccttactcccataccatgttccttgaatccctcaaggagacgccctgtggatatgctactttaataagcacacctgcatagagaagggctcgggggtaaagtataggcagtgcatatacagcattcccaagcagaaggtaagcaagaacccttccaccacagcatggagaactgttgctgcgagggctcctctaggacacaatgcagagcctcaaggcagagttattgcaattcatgtcagtgctgcttcctcaccgcagaggttcctgaggtgactgtgttttccaagtctcctgtgatgctgggtcagcccaacaccctcatctgtctcgtggacaacatctttcctcctgtgatcaatgtcacgtggttgaagaataggcactccgtcacagaaggggtttctgaaaccagcttccttgccaaaggggatcattccttctcaaagatcagttacctcaccttcctaccttctgctgaggatatttatgactgcaaagtggagcactggggcctggatgagccacttctgaaacactggggtatgtatgaattccacctcctgtggtgccttcttttctttgtcaagtccaaaatatcctgcctttcagccccggagtctcaaggctcaaagcatgtttatgacacttcagggtttctaataacagagttcactctcttccctaagcctggtgccctgagacttcatagacccaacagcaccatcaccctcctcaaccccccactccatctcacacctgtacttgaaccaacactgtattctgactttcacaacctcattttcacagaacctgaggttccaacccctatgtcagagctgacagagactgtggtctgtgccctggggttggctgtgggccttgtgggcatcgtgatgggcaccgtcttcattatccaaggcctgcgctcaggtggtacttccagacatcaaggacctttgtgagctgcaccctagaaaggaaggtaaggattcagatttgtcagagctgagagttggagacacagtccaggaggatggaaagtgggaggagtttgtggacccaaatgtggttggaaggttataggagaattgggagaggggatgatgacagcacagcagccccctaaaatccaaccatctatgtctgtcctattgcaggtgcactgcatgcccacctcccagagcagaagagtggacctgataggccacctagcactatttccttgcccagttcatcatactcctactctctaccaatgcttctctgtcacctcttctctgggactcaagaactatatcctctgagcgctaaccctttaaattctaccccttccttgactgcctgtttttgtttgtttgttttcttttcttttctcaattgtcaactacaatgagatctctgggatatcccaaccagttacctgatccctcattactctgatctagcattcccatggaaataataattttctctttaagagatcctttagatcaatttttcctgtctttcatctcagggctgattaggactttggtccccgcttttattataccttcctaatctcactttccatattatgtttcatgcccagcaacaccagaaaatgcaggtataggctgataatattttgatatcttaggtaaggataatggttctctcttcctgttattctcatgtttgggtactgtcacactcccccaattcagacaccaagaaaagtaatataagccctctgaccttggtgtaaatttggtatagaagaaatacaaagccaagaaataagttcatacttcttttaacataattttagaaagctatgacagagaaataagttaagataaagaaattttgaatttcaaaagtaccaaaagacaaattgttttccaaaactttaaaatttcaatttgtgaagaatgaatgatgataggagaagctttcctctcccatcctcacccatgagaagataagaattctttaggcaggaaaataaatggaagtcgggtaagagagcattagaataagaccataaagtaagtacctgaggacaggtacttagggacagcaacaacaggatgagaaagggagtagaaatcatagacatggttaagtttcttagaacacaggtgtagtttgcctcacctcttacatgaatctcttctagataagcacgtagactttcctgtgccgtggtggcatatcagggatagtagagtgagtatatctgcaggatgtttctaggcagatcatcttaggtcaagctcactgaatccctgtgtatccctgtgcatccctgggcacccaaggaaactgcacaacaccccaataactccagtcccgtgccctacccctcatccctcttgtatttggaaagaatgaatctatgagagagaaaggccagcagggacaacatagtggagataatgtactggcagctatggatgctgtattctcttctagattcattgtcttctagtggaaacttgcagaggaaatggatcaacagatggaattttctggtgttcttgagttgtctaaagcttcactcggaaagtgtatgtgacttgactcggagtcattttccctttgaaattattttaggcacatattggccttagtcttttcactctgcaagtactgtgtccatacatggtgtctaaggcaatattatggaacagctgtaaaatgtatgaggctgtccctggccacaccacctgtatcagtgaatttaaagtgtaattgggagaaaaaaaagacaattttaacacaatagttgacatagtagagtttgatgaaaagaaacttaaatccaaattcaggattcagcactttatagctaatattttaaacattttaacactgcgcatatgtattctgagactcatctttctcatccattctctggaagtaataatactttccttgcagttattgacagaatttgaataatcttgattacacataatatggaaatacataagaaaacattgctatttgtatctgtattattaaaaagaattgattatatcatattaaaagcacttctctttttctgagtccattaatgatttagaagattcaaaaatggagctgtgaatgaatttcttttcataagttaaagagaggattttgttttccccagcaacttagagactctgagattggcttaggctaagagaatatagggtatagcagtcagcgacatgtcactagtggaagattgctaagagaattcttagaacagtaagtcgtaagaatttgacttgaggtttttaagaccaaagatatgctatattgtaacagaccttatgcatatttactttggggataattcaaggatcaagagttacctgtgaggtagaagtaagagaataattaacaatggagactaggaactagtaaatttagggaatctgacccagaagttatcaagaaaatgtaggtaacagaacacagaggaggtcaggccagtgaaactactctgcattgtattataatggtaggtacatgccattacacgtttgttcaaacccacaaaatgtacaccaagagtgaaccctaatggaaactatggactttggtgataataatctatcaaaatagtgtcatcaattgtaataaatgtaccactctggtaagggatgctgatagtaggggaggctgtacctggtggggacacggatatatgggaaatctctgtaccttccactcaattttgctgtgaaccttaaattgctttaaaataaactgtattgggatccctgggtggcgcagcggtttagcgcctgcctttggcccagggcgcgatcctggagacccgggatcgaatcccacgtcgggctcccggtgcatggagcctgcttctccctctgcctatgtctctgcctctctctctctctctctctctctctctgtgtgactatcataaataaataaaaattttaaaaaaataaaataaactgtattaaaagaatgtcagcaattatgatgtcaaaggtataaaataaaaattttagtataaaaaatgtaatcatctgaaaatgcactaatgtactcagggagagtttttggcaataggctgtcaaataaatgttatataaatctcaaggaatcgtgagatgggaactcaggaatttgggtaaaggtgtgtgtgtgtgtgtgtgtgtgtgtgtgtgtgtgcattattgtactataaggtgtatactgaatcccattatgaccagtgccctaggaatacacaaatactgacttactcagactccttctcaatgaaatactgaggaaaacaaatttaatggaagatgcattttattaagggacttgcttcatttgtaagacttcatataattttaaaatagaatttatattaattctaacaacaagcacaatcatttcgatattagctaaaagttaaaagtgagatcatcacatgacattactgtaaacaaagatatcaatcttcatgatactaaattatgtgattttaaaaattatttgagttattttaattatttctgattgtgtgcataaattgtgactattaatatttaatatcatactatttaaaaatacataattagaaaatccttttattcagcaaatcatttgcagggaaaataaagaacagataaaattcatattaaaaaaattaagatacatatcaaccaaatgttaggttttgtttggatgcatattcaaataaaagaactgttaaaaaattcttgtgaaacaatcacaaaaattgaactctgactctattaagaaatttttaatctaattttgggtgtgataatggcaatgttatgtttccaaaaagtcattaaattttagatttcataataacatattcatcgataaaatgatatgatttataagaatatcatcaaactaatcgagtatatgtgtaaaattaagtgggtaggtttacaaaattatccatgaattaataattattaaaggtagactgttgatacttggcactattctctctaccactacatattgttgaaattttccatgataaaaagggtttcttttaagtatcccaggaaagacaaagaaaaaactaggttgaaaagcattctgtttgaagttaacattcgtttttaaggttttcctcattttttatccgtaggaagccatgagtatccaaaacttgctccacaccatgaacctctcagaaatgtaaccctaaagaatacatatgtcacaaggataatattgaaggaaagcaaagtaatactctctttatcttgactggactaagccccaaacatggctaatatatacactaatttaattaataatgcaaaaataaaaatggttattgaataccagtgttgtgacacataccatactacattctgagtgtattaaattgatatgaaaacagatatgttcatcgtcttcacagactttacattctagtaggaagaaaaatgcatatacaaaatagttccacaaatatataataacaaactctgaagaatttataaaggaaatgaacaaggtaacacataaccattgcacaggaattaagcagttggtggagattagaggtggcttgaacaaatgtatgagatgaaatagatattgtatagtatgtaaagcaaataaataaataaataaataatcctgtaaaaatagaaataatggacttgagctataccttagaccaaatggacctcatggacattttaatgacctgaatagacatttttccaagaaaagcattcaaatggccaacagctaacatgaaaacatactcaacatcattaatcattaaggaaatgcaaatgtaaaccacaatgagacatcacctcatacctgttagaatggctatcaccaagaaagtaagaaataacaagtgttggcaagcatatggaaaaaagggaacccttacacactgtttttcagaaagtaaattggctcaaccaaataatatggaggctcctcaaaaaactgagataactgcaccttcatatccactgcaactttacatactgtagccaagacatggaaacgttttaagtccccactgatgatgaagggataaagcaaatgttacaccaacacacaccacaaaatggaataccagtcggtcataaaaaagaatgaaatcttgccatttgtgacaatacaaatagaccttaaaggttctatgctaaatgaaataagtcagacagagaaagacaaataccatacattttcacttgtatgtggaacctaaaaaacaaaacaaattagaaaacaaaaccagactcctaaatacagaaaacacactgatggttgccagaagagagaggggttcggtgttgggcaaaatggatgaaagtatcaagaagcataaacttcagttttattttatttttttaagattttatttatttattcatagaaacacagagagagagagagagagaggcagagacaccggcagagggagaagcaggctccatgcagggagcctgacatgggacttgatctgtggtctccaggatcacacctcaggctgcaggcagctctaaaccgctgcgccacgggggcggcccaaacttcagttttaaaataaataaaccatggggatgtaatgtatagcacagggaatagacaatactactgtattaactttggtgacaaatggtaactagacttattacagagatcatttcataatgcatatgaatgttgtacacctgaaactcatataatattgtgtgtcaattatacttcgattaattttgtgtggtgacagatgttaagtaggcttattgtagtaatcatttcacaagatatacaaatatcaaaccatgtgtacacctgaaaataatatagcgctatatgtcaattatacctcaataaaaaagaaataactgttttcacttttaatgaataggtcttggcaacaatttcttgggtataaaatcatagccaaagggaaaaaaaaagaaagaaaaaaaacaaaaccaaaaaaacccaaataaacaaaaataaatataactacatcaaatttaaaacttctgtacagccaaacgattagccaaatgcaaaggcaacctgtggaataagaaaaaaacatattttgtaaaccatctatctcacaagtggttaatataaagttactcatataaatcaagaattaagaaaacaaactgatttaaaaagggacagaggaggacttcagggaagagagcagagtagctggaccctaagttcacctcatcccatggatacaactagataaaatcaacatcagtgtaaataccccagaaaaccacccaaagactggcagaacagactctccacagctaaatggaaggaagaggtcacaaccaagaaggaaaggagggcagagatgggtcaggaattaaagtacctatacaactgtccacaagagagggctgctgtggcctcagagaggggtaagaaggaggccttcacaccaggcaggtggaacccacacaggaaagacaaacccctataacatttgactttgaaaactagaacaacacaattttgccagttcttacaatcaatagggcctaacatctgggtctttaaaaatcatcaggcttgactcccggggagcctgggagccggagggcaatagaaaattgagtccctgcctttaaagagataacacaacaaacaatcccatggagatacagcatgcaagcagcagtttgaaaaccaccaggggtgaggggtggtggggttggatggtggtagtgtacactggagggagttttgtttactaatctcagagcatgtgttggagtggcagggatctttgagaggcttctttaagaacaaaagagctggtaggttccatttgcatcccttatccccatcctagacacacagacacttgcaggaaccagggcagcaacaacacgttctacctaacttgctaacagtgcaccccactccccacattctcctacaaacatacccacttcaacccgatctcagctccaggagctgtctcacatcagacctatacaaaccttgataacacctcatgccctgccagacttctcctgtggatctgcctctacaatacctctggccagagcccatccaaaggtgtgccacaggcctggcagggtgcggcagccctaaaaggagccagcacaactccaaagtggctcctgcctggggaagaggggaaaggaagatcactgcatagatgagtccaactacagccccagcaaccagctgagggcagacatctggtctgactgcaggccccacccaagagtgaaagcttctcaaaagacaacacagagaaagcaaccagcagttcagtgttaccctatctctggcaaacacctggtctgattcaattcaggctcagtgcagtcccagattgcctcattaacacaaggacaaaaccctgcctccatcagggaaagagagccattgcagacagctgaactgaagtcgaatgtggctcagcaacaacagtaggggacatgcaacgtataggagacaaccctgaagcaccaggttctggtgaacaggggacattggactacagggcaccacaggacctctccttcataaagccactaatttcaagagcaggagattagctgacattccaaacacatagaaagagaccgagggagttggacataatgaagaaacaaaggaatgtgtctcaaatgaaaagaataggacagggaccctgggtggctcagtggttgagcatctgcctttggctcagggcgtgatcatgcaggcctggggcctagttccatattgggctccccacaagaacctgcttctccctctgcctatgcctctgcctctctctctctctgtgtctctcatgaataaataaataaaatcttttcaaaaaattaaaagaacaggactaaatcataggaaaagaattcaaccaaaaggggaaaattaatatgcctaatagacaatttaaagtaacggtcataaagatattcaacgcactcgagaaaagagtggaggacctcagtgagatccttaatgaaaagatagacttgaggaaggtggcagagtagggggaccctgagttctccctgtcccatgtttgtcaccgattatcatccacacccaagtcagtaagccagagagtgatctgaagactggtagagcaaactccacaactataaatagagaagtttcatctgaaagttaacccttcagctcagaattgtcgaaggaggctacctacaagaaggagggggctgcacacaaggagagggctgagaaagaggccctcacaccaggaagctccacagggaagattaatcctcataaaagctggccttaataaccagatgggctgaattctgtgagtttttaaaaccagtgagacctggggcctggaactttaaaagtcagctgacccagcactgggtgagctggaggggtgagtgatagcaggatcactgcctttaacaagacagcaaccattttcacaatatttagtctttcaatccatgagcatggaacatttttccatcccttggtgtcttccccagtttcgttcacaagtgttctgtggtttttatagtacagatgctttacctcattggttaagttttttcctaggtatcttttggtttctcgtgcaatattgtgaaaatgtctctgctacccagagcaatctacacattcaatacaattcttatcaaaataccatggactttcttcacagagttggaacaaataatcctgagatttgtatagaaccagaaaagaccccaagtagccaaaggaatgttgaagaagaaaaccaaagctgacggtatcataatactatattaccaagctgtaatcatcaatacagcatggtactgacacaaaaacagacatatagatcaatggaacagaataaagaatctagaaatggaccctcaactcgatggtcaactcgtcttcaacaaagcaggaaaggctatccactggaataaagacagtctcttcaataaatggtgttgggaattggacagccatgtccaaaagaatgaaaccagactgttctcttatactatacacaaaaataaactcaaaatagatgaaagacctaaatgtgagacaggatccatcaaaatcctagtttttccttttgaccttggccacaacaactttatgcaagacatgtccgttaaaggcaagggaaacaaaagcactaatgaacttttaggacttcatcaagataaaaagctcctgcacagcaaaggaaagagtcaacaaaactaaaagacaacctacagaatgggagaggatatttgtacatgacatatcagataaagggctagtatccaagatctgtaaagaacatatgcaactttacatccaagaaacaaacaatccagtcttgaaatgggcagaagacatgaacagacatttctccaaagaagacctacacatgggcaacacattaaaaagtgttccacctcacttgccatcagggaatacaaatccatacctctttataccagtgagaaaggctaaaagtaacaggacagaaaacaacaaatattggggaggatgtgggcaccctcttacactgctggtgggaatgcaagctggtgcagccactctgggaaacagtgtggaggtctctcaagaaattaagaatagagctaccctaggacctagcaattatactactgggtatttcccccaaagatacagagatagggaaaccatgggacacctgcaccccagggttcatagcagcaatgtccacaatagccaaactgtggaaggaggtatgatgtccatcgacagatgaatgcatagagaagatgtggtctatagatacaatggaatattactcagccctcagaaaagacgaatacccaccatttacatcaacatggatggaactggaggccattatgctgagtgaaataggtcaattggagaaagacaactatcatatggttttactcatatgtggaatataagaaatagtgaaagggaccatgagggaaaggagggaaactgggtggggaaaaattagagagggagacaaaccatgagagactcctgactctgggaaacaaagggttctgaaggggaggtgggagggaggatggggtaactggctgatgggcattaaggaggacacacgataggatgagcactgggagttccactatatgttggcaaattgactttaaatttaaaacatgaagccaaaaatatatttaataaaaatactcaaattttgaccttctaaaaaaaaagacagcagcctgcacagaggcaacataaaaagggcagttgacacaggatgggggcaaacaggggagagatctgttcatagtgactttagagcatgttaggggacttctctgaaagaggagctggcagtcaccagtttctcacccatcctgccagcataaacacagagccacctgcagcaagtggcactgcgcagacatttgctacctaacctattagcagtgtgccaggcccacgggttctgaggacttgccactccaagcccactagcctcagccctaagctcagggcaaatttggttaaagcctcactgcacccttccaagctgcaggatgcacagccttggcagagtgcacgctgccaccacacactgtggccagccactccacagcacccaggcactgagcagcacccagccaccactgagtgctgtgcatagctcccaccttgcactgagaccagcttcatgcccccaaccatcatcctgtgctaggccctgccgaacccagccatacccagcctcagtcccctggctaccccagcatgtagtccccaaccacggcagtgcttcagtggatctggcttaagactcgtgtcccagtaaaaattttgctaacacctccatcctgtgcccaaatttcctggcagacacagccctcagagctgggcacttgggttccactagcaccacaaagagcaagcacagcgcaatagacagagagccagtgcagacaatgcactgaaaggaaaagtgactcagacacaacacacaaggacactgtcctgaagtgttaggttcccataaactggagacactatactgtaggccactgcaagacctctccttcataaagtcactactttccagaacagaagacagagctgactttcttaacacagaaacagacatagagaggcagattaaatgaggagacaaagaaatttatccaaaatgaaaggacagaggagctaagattgcagcactttaggggaccctagacttgtctcatccctcgaactagttgattatcaaatcaatccaaataccccagaaatcaacctgaagactgacagaaccattttcacaactacaggaatagaagaagccacactgaggacggtaggaagtacagagcagtggtttgggggagaaacagatcaaggggctgcagagaggaggaagtcatggtcacagagaaaggcaagagagagcagcacatcggggaatgtgcaaggagaacacttccccccaagccactggctgggaaaatgaggtgggggggggggggcaggatttcaggagttcttgcaaccagcaagacttaaggactggagttttaaaggtcagggggtgatctgaagaatgcttgggagacgtgaggggtggagagaggagagattattccctcttcttagggctggtccctgacaggcagagttcagggagatgcctctctggggacaaaggagctggctagtgccattaccctcctccacccctcatcataaacacagagcagcctgtggaaggtagcttagccccgaactatcttcctaacctgcttacaccaagtgccacacctctgcactccagcacaatggccaatttccatcaagctcagcatgccccttccccagaagaccagcagaaactctagtccacaccatgtcttccaatagaaggttccgcaaggcttcagttctaatggaagtagtatcaagtctcatttaacaagcagaccagagcatgcccacttaaaatttgccaattctggtcaagaaccaaacagcacacactgcaggaaaggatggcctctgcagagaattatcctgaagaatggagcagccaaaatagaacggctgagcgcatgcagcacacacaagacacattccctgaaatcccaggcactggacgctatatgatctcttcttcatgacacattactctcaggagcaggaaatttagcaggcttttcttttttttcttttctttttttttttttttttttttttttatttacttattcatgagagacagagagaagcagagacacaggcagagggacaagcaggttccctacagggagcctgatgtaagactcactctctggacccgggatcacaccctgagccaaaggcagatgctcaactgctgagccacccaggtatcccttaccaggcttttctaacacagagaagaaggtagagacatagacaaaatgctaagatggaggaattcttcccaagtgaaagaataagagatccaagttaaacagatataagtaacatgcctgatggagaatttaaaacaacaatcataaggatactcactgagcttgagaaaagtatgaaagacttcacagaggcccttactacaaaaataaaagagttaaaatagcatcagtcagaaatgaaaaatgcaataaccgagattggaaacagactggataccatgaatacaaggctggaagaaacagaggaatgaataactgatatagaacacaaaataatgggaaataacgaagctgaacaaaagagagaaagaattatggaacacaacagacttagggaactcagtgacttcatgaaatgtaataacatttgtatcataggcatcccagaagaagaagagagagaagagagtgcagaaaatttatgtgaggaaataatagctgaaaatttctctaatcctgggaaggaagcagatatccagatccacgaggcacagtgaactcccaccaaaatcaacaaaagcaggttaacaccaagacatattgtaattaaatttgcaaaatacaaaactaaagaaaaacttctaaaagcagcaaaagtccttaacttacaagggacgacccataaggttagatacaaatttctcaacagaaatatagcaagccaggagggcatagcataatatatcaacatgctgaatgggaaaaatctgatgccaagagtactctatctagcaaggctatcattcagaatagaagagataaagtgtttcccaaacaaatattaatggagtcatgagcaccaaaccaccccaggaagaaatattaaaggggaatctctgagtggaaaggaaagaacaaaagtgacaaagacaacaaaggaacagagaaaagctgcagaaataatgacaaaacaagtaataaaatggcactaaatacaatctatcaataattactctgaatgtaaatggactaaatgctccagttaaagacacagggagtcagaatggataaaaaacaaaaacaaaaaccccactctcctatgtgctggctacaagatactcattttatacctaaacacaactgcagattaaaaatgaggggattggggatccctgagtggctcagaggtttagcgcttgcctttggcccagggcgcgatcctggagtcatgggatcgagtcccgcatcaggctcccggcatggagcctgcttctccctcctctgtgtctctgcctctctctctctctctgtgtgtgtgtgtgtgtgtgtgtgtgtgtgtctatcataaataaataaataaatcttaaaaaaaaaaatgaggggatggagaaacatttagaaacatttatcacacaaatgcttgtcaaaagaaagccagaatagcaatacttatattggacaaatgagactttaaaacaaatcctgtaacaagacatgaagaaaatattatgatattatatatcataataaagtagatactccaataaaaagacataacaattgaaaatatttatgcagccaatatgggagcacctagataaataaaataatgaataacaaacaaaggaattcattggtaataatacaataatagtaggggactaaaacacttcagttacatcactggacagattatttaagcagaaaatcaacaaggaggggtgcttgggtggctcagtttcttaatggctgccttaggctctgatagtgatcccagagtcctggaatcgagcccttattgggctccatgctcagcgctaagcaaggagactgcttctccctttccctccaccagctgttccccctacttgtgctttccctctctctctctctctctctctatctctatctctatctctctttgtcaaacaaataaaatccttttttagaaaaaagaagaaaagaaaatcaacaaggaaacaatgactttgaatgacacactggaccagatgaactttttttttaagtttttatttatttattcacgagagacacacagagaggcagagatacaggcagacagagaagcaggctccatgcagggaacctgaagtgggactccatcccaagactccaggatcatggcctgggccgaaggcaggtgctgaactgctgagccacccaggcatccctggaccagatgaatttaacagatatatttggaacatccatcttaaagtagcagaatgcacattcttttcaaggacagtctccagaacagtcacatactaggtcacagatcaggcctcaataagacaaaaagactgagatcatactgtacatattttctgaccacaatattatgaaacttaaaggcaatcccaagaaagaaattcatagaggttaaacaaaatgctactaaacaatgaatgggtaagtcaagaaatcaaagaagaaataaaaaatacttggaaacaaatgaaaatgaaagcacactggtctcaacctttgggatagggcaaaagtggacctaagagggaagtatatagcaatacaggcttaccttaagaaacaagaaaagtcttaaataaacaaactaatcttacactgaaaggagcctacagctacaggaaaaagaacaacacacaaagcctaaagcagaagaaaggaaataataaatatttgagcagaaataagtgatacagaaactaaaacaaacaaacaaacaatagagcagatcaatgaaaccaggagctggatctttgaaaaacttcatcaaattgataaatccctaaccagacttatcaataaagaaaagagaagggatccaaataaataaaatcaacatcgaaagaggaaagatcacaaccaataccacagaaatacaaacaattttaagaagttattatgaaaaactatatgccaacaaattgaaaacctggaagaaatggaaacattcctagaaacatagaaactaccaaaactgaaatgggaagaaatagaaaacttcaaaagaccaataaccagcagagatactgaatcagtaataaaaaaaagttttccaacaaacaaaaggccagggccagatggcttcccaggagaatcctaccaaacatttagagaagaattaatatccactcttcccacatttttccaaaaaagaaatgggaggaagacttcaaattcattctgtgaagccaactaccttgattctgaaaccagataaagactccagtaagagagagaactatagtctaatattcctgataaacctggataaaaatttttcagtaaaaaaattcaataaaacactagcaaaccaaatccaacagtatattcaccatgctagagtgagatctatttctgggctgcaaggctggttcaatattcacaaatcaatcatcatgatacactacattaataaaagagaagggatgcttggggggctcagcagttgagcggctgcctttacctcagggtgtgatcccagtccaggatcgagtcccacattgggctccctgtaaggagtctgcttctccttctgcctatgtctctgtctctctctctgtgtgtgtctctcatgaataaataagtagaatctttaaaaaaaaaacaaaagagaatataagaaatatatgaccttctcgatagatacagagaaagcatttaataagtatgacatccacacatgataaaaaaaaaaaaccctcaccacagtcgggtcagtgggaacatacctcaacataataaaggccatagacaaaaaccccacgtttaatataatcttcaatgatgtttcttgtcagaaataagacaaggatgtccgctctcaccactgttgttcaacatagtactagaagtcctaacctcagcaatcagacaacaaaaagaaataaaggcatccaattcacctagggagaaatcaaacttttactatttgcagatgacatgatattctatatagaaaacacaaaggactccagcaaaaataagaagtttctgcacagcaaaggaaactatccacaaaactaagaggcagcctaagcagtgggagaagatatttgcaaatgacatatctgataaggaattagtatccaaaatccataaagaacttacaaactgaaccctcaaaacacaaataacccagttcaaaaaagagaagtcatgcatagacgtttttccaaagaagatatccagatggtgaacagacacatgaaaaaatgctcaatatcacttgccatcagggaaatataagtcaaaaccacaatgagatcccacctcacaagagtcaaaatggctgcaattaacaacataaacaaaaaatattggcacacttggggagaagcgggaactctcttacactgttggtgggaatgcatactggtgttgctgctctggaaagcagtatggatgtttctcaaaaggttaaaagcagaactacactaggatctagcaattgcactactaggtatttaccaaggaatacaaaatactaatttgaagagatatgtgcagacaataaagagtgatgcaaaaagaaacaaagagatccaaataaataatggcaaaggtgtagttagtagagagacaggcagagacgcaatgaaagagtgagagacacaacagagacagagaggcaaagacagacacaaaaagatgtcgagaaaccctgtgttgattacagcaatattcacaatagtcaagatatagaagcagccctagtgtccattgatatgtgaatagataaagaaatgcggcataaatacaatgcattattactctaccataagaatattcaatcttaccatctgcagcaacacggatgaatctggaagatattatattaagtgaaataagtcagacaacgaaagacaaatgccatatgatttcacttatgtgtggaatctaaaggacaaaacaaatgaacaaacacacagaaaaacagaaacagactcataaatacagagaacaaactcatggttgtcacagggcagatggatgggaggataggcaaaataagccaagaggattaagacgtacacacttccagttataaaagaaatacgtcatgtacagaaaacatcagtatagtcaataatattgtaataaggtgacagctggtgactgtacctattgtggtaagcactgagcaatgtatggaattgtcagatcactgtgctgtacaccatatactaacataacatgcatgtcaactatgctatcacaataaataaataaataaataaataaataaataaataaataataaaaatatgtagagaggcacactgaaatatattaaagggacaaggagagacacatagaaaaataggtgcacacatggaaatataatgaaaaagagagagagatgaacatctcatcaaatgtctggatctagtaacttctgaaatcaacttgacctcagacttccttgtaacatgaacagagtacacttgacttgggtatctatcatgtgaaaccaaaaatagtacttatattactagttatactttttcaaaaataaaaatggaccttgatcagtgccaagatctatttgaaatgtcactgtggttttcagagacaccgcgggccactattacccacgccaggatacttccactgtaagcttacacgcgaatactccgcaaacctaaagaaaggccagcacctccttaggccattgcactgaacaatactcaatatccagaaaggacgtgactattgaattgattttccatctccatctcccccgcctgctcttcatttggcacccccagatgcctccggtctcccttcaaggagcaatatgaccctttcattctgcactggtttcctgcctccacccagttaagaagactcagggtacagagaactcataatcacatttaattatgataaaatctctatcttcaggtaaatggcttcaatgtgcttctcttgcacaatctgtgaaggaagaatggaaacaggaaaatcccttggggcctgagtagatcctgtagcagggaacacacaggtcaatgcaggaagcagaatcacacccagatcctcaagagtcctcagagtcatgtaggactctgatctatgtgggggacagtctgtcaggcagctgggaattctgggcagggacagacggacactacaaaggatggaatctccggtatcctcaggcatcagtgcaggagccctgtagaaaagagagtgatcagcagaggagaccctgacagatgagccctctcccctcctctcagggccactgcagcaccagagaaaactgagggccagggcaggcagtcatcacctcccccaatatttctgtaaaggtgaaaccaactaaagagaacatggcactccagctgcacacagatgtgtgggaggcagtggagcagctcttgtcctttaaggggatataaaaacgtgtcaatctttttagtaaacataataactcaccatctttgaaccactagtggcctttcacatgtaaattcacacaggcagcagccagcaacacataacacaaagtgggcatcatcctggtgtctaacacccaagatgtggctctggttccgagtttcacagacagatagcaccaacgttatggcttgattccagggaacaactctggatctgcctacacaaactgggcaatcttcccccctaactcttgatctctgtagcagggaataggccatgaactgagaccattgtgcccaggtacactcacctcatgctcttccccctttcacccgtccctgcaaccccactgaatcagagcagaaatagtacctgccggtggagacccccgagatcctgcaaaaggaagtgatacagaaaaaaaaaggtctcataaatagccaccttctccctcaccccaaatggaggtgagataagcaacttaattgaattttactttctccccactcatccactccaagaccttaactgccctaagctaaaatcccccaaaatcaatgacactgtcactagaaggaagggaagcagatgctctgaccctcttacagaaagaaactttcagaaaggagccagggagccaatgatgaactataaggaagccctagaatatgctccacctgttacctctgtggtagggctccttttcaaccaataaatcagattccagagtctccccctaggtggttccctctctttccaccaccagcccagcctctttcctttcagagtcagaaggaaagagctaatctagagacagagccaacccccccccccccttagcaacaagatactaatcctgtcaacccccctcttttaacgatatgtatcccttggaatctctccatgccacgaaagtcgccggacggtgcacggctggcgccccccccacgctaccccccccccgccccactcccttctctaccccaccccccccccccctcccctcgccccctccccgccccccccctccccccccccccgcccgccctccccccccccccggctccggagcaacccccccccccaacctttaacccccccccccccccgaacaaaaggtctcaggcatagcccatctccctcatttcccccagaatgccttacctttctggctcctgtgacggatgataaggccaagcccaaggaagatcagccccagcacgaagccaccaatgccactcagcatcttgctctgggcagattcagactgtgcccctggggagcagagactgagagtcagagttgtctccacacccccaggctccctttgggaagcctgaagtccagtctgaggtacaggaggtggaggtactgggtgaacctgaccacccctaggagagggaaggacccaccattagatccttgcacacagtgggtatgtggggggaaggagggaggctgaaacctgctcctccagacacatccataacctcaaacaccaaggccccagtcaccagccagggcagtaaacccttcagagctacagggctgcgttgtggggccaaggtatggagaatgatctctctagtatctagaaagaccacgagatcaagattctcctgatgcccctgccgtgggacaagaggtactctaatctcctgtgatttccacctcagtagtgacatcaaggataacaaatagaatgggatgggctagaggaagctctgccctctgtctgtggggctcatcatgacaggaaacaaacttctccttacgccactgcactgtgatggggctctggaggctggcgtgctccacatggcaagtgtagacatctcctcgctggggagtcatctccagcatcacaaggatctggaaggtccagtccccattcctaataagtggagtggacacgacaccagctgtctgctcctggtcattccgaaaccaccggactttgatctggcctggatagaaatctgtcactgagcagaccagcagattgtggtggttcagaacctctgtcctggacggggagatggtcactgtcggttccactgaggggagtaacagacaagaaaagacaatgagatgtgagactacacagcaagtctccccatggagaaaagtcctcccttggtaccagcatggaaagatccctggattccaagtcttggattcggatctcagcttggccaccttattagtttgcatgaacacatgagtcagtttacttttcagagtctgaagaaataatagcaatcattctaggaaagttattctgttgatattaatcgataaaatgaagcatttttaaattataggtcgctgcattacacatgctactatttataacattttcaaaaataaaaataataaatctggacagctctccctccatccctactgacagataaagtggctgctaatccctaacatgcaaggtggttagttgtgaaattaaatggcgcaatatagacggtgggtggtaaggtacttttctagaataggtatgtatgaaatggctacaattaacttccagaaagggtgtctacccctgaagtggattgcgatgccctgaggacgtgacccagggggaacaggatatgcagggcttaggccaaaggaaacctgagacaaatcttattcaataacttagtagcatcgattgattgactccaaaacttcagctccttttatactggcatgtgttgagaatttctaagaaattaaaattctgcctcacaccgcctttcacaaatagtttatatttttagttaacactttcttctttgcattcacaaatcctaggctattaagtaagattcaagtcactaagtttactttaaagcattaaacaaagcagaaaagaataataatagggtccatttttaagtcttatttactctgctatttttcttgagcctaagtggatgtgcagctgagtgcacttactcattaatttcacgaaggtttgcactcacacggcttgccagtccctgtgtcacacactaggcaggcaaggataaggcagggcctcgcctcagaaatgtccaggcccagtgacagccattagggaaaacagaattaagatgaataataatttgaaccagagtcaaaattcggcgtgtgacgactctgccttgcttaccaggtgtgtgcatgcagctcactgagcttcccacctgcagccccagggacaggtcactgcaggagcccggggcggggctggggtgctcagggggctcggcttaggaaaggtggggagggagcaagcaaggggtctcagggcgcgacatgggggtgcgtggagtgggggcatgagcctcggaagcgctgctcccccctccccgaacggaccccccatctctgctgagaaggcagagggccgggctcagtcccccagctctggcccctcgctggggacgcgccctgcctccctgtgcgcacctgggccgggtcccgcgaggggacctgggtggggagcccgcgggggcgaggagggtgcgctcacctcgccgctgcaacgtgtagagctcttccaccccgtagttgtgtctgcacaccgtgtccaccgttgcccgctcctgctccaagatctccttctgcccgttccagtactcagccgagggccgcccgagctccgtgaccgcccggaactcccccacgtcgctgtcgaagcgcacgaactcctcccggttatagatgtatttagccagaaaccgcacccgctccgtcccgttggtgaaatagcactcggccttacactggtacacgaaatcctctgcggggagacagccgggccagtgaggcctccaccgctcagcccaagcagcggccaccgccctggcaggcctctggggcagcgccagggcccgagaaacctgaaggcctcccggctctgatgcccgtcaacccggccccgagcaccctctctcccaggcctgcccgccctcctcggagagcttccagagctgccttcatccagggaagggagggaggaaagcccctctggaagggcaagccctggcacccctgaacccggcctgagcctgacaactgagctaaacagggcagtcgggtggattctacatcccgacttggactgggatcaggacgtgcccacaagataccccattttcttgtggactccaggaacctcagaggcaaataagtgtccccattagcacaagagggaatgtgcagaaaggtccagaattgagctcaacttcctcctgacaagcatattctaccggcccccagcaaaaggcctttcttctaaggcctgggttaactctgagtttctgtcgcccacccacccccctgcagtgtgaggtttgctcactcctgcagggctagaaggaacccacaccttccaagtcctagaaagaaacattttattcacagaaagaacaggcttttcaaaaagataaaatagattccaattaacctgtgccaatgaccagcttgagtaggttactaaacagagtatttcctatcataagtataatttgtaaaacggaagtcataaaacctacacataggggtgttaggaagatccaagagaacttatagtaagatcctaaccctatcgctgaaacggttcctcagtatgtgctatttcccttctttactttctccttcctcctacattcagtccaccatcatctcaagtctccgaatgccacacaagttactctctgaccataaactagtgagacttgaagttaagactccctgtctgtggccacccagtcagcgtcactcatacaccaagagttcatgcccatgtgcactccactcagaatccagtagaacatagagtcctttgtaccaaagactaagatgacagagaccgttgctgccctacatttccccaacatacaatcccacagtgcatagcctagacaaagtcttgggggacccagaaataaaaaatcctactgtgtcttctttggacaaattgttactttcaaaaataactccaatgtcactttgtcctgtcagtggttgcagatgcacactttgtttcctctaccccattaggaggattgagcccacaggatggggatgtcctcatctcatccttagaggtggacatgagaatgtcacagagctctcttccccaaagagaggaaactgtgataaaagtctatattctgagatcatagaaccttccacactcccaccaaaaggtccttcagagcctgttccccagagcagtggccctggggagcaggtgtcctgcacttacgtggagagtctctgccctcagccactgggatgctcagcaccaccaggatcatcatcacagctgctgtccagaagcctcgggggatgcacagagtcatcttcccagacataactgagaacaaaggaaaaagttggtagtcaacacagctcctacctggtggctctgaagtactcacttcaaagaataaaaatctgtaaaagcttccatccatagtaggattggagagttcctagggagggaaccaatcagcaccggagctgaagtacctcacctgtctccgggcagacattcgttatgaaggttctcagtccagtgcctggcgctgtgtcttcatcagattacactagatgaacacttgaggtgacgattttctcctatagaagacctaaagattgaatgccttaggggtttaagaaactgaacaaaaaatgactcgagagtagacatctttgtgcaattttggattatttagttcttatacctttggtttttagtaaataagtgggatcctatttcagggaagagaaaattattgtcacagagttgttcacttctattgtcttagacactctgaggagccttcagtcacgctgggaagagcatagttcttaggaggaaatggttttgaattgcaattttaccactaataggctttatgagagcaaattactgagcctctttttgcctcaggcttctcttggtaaaatgtggatcacgttgcctgcattgtatatccaggtcattatatatacgaacttaagagtaataggacttgtttaatattgcaaagtgttcctcagctgccacatgttaactgttgggaataccaggttaatatgcggagcaagagggcagccccactggttcagcggtttggcgccgccttcagcccagggcaggatcctggagatccaggatcgagtcccacgttgggttccctgtgcggagcctgcttctccctctgcctgtgtctctgcctctctctctatgtctctcatgaataaataaataaaaatctttaaaaaaatatgcggagcaagataacaaggaaaaaaagtggtgacacccagccctgtgggcaagtgattcttcattatgcaaggatcttttacatttgtgcttttgactgaaagtatttgaaaagtcgagttcacttttatgcaggttcctctgatatcagcaaagatgcaatccatgaacattcccagcattcacacaaaatcacctttcatttcaaggacagagagcaaaagatgtggagaagcattttctgggtcctgaatgatgttaatgaaggagcagatgttagagtcacacactgtgtatagatgtggcacttactgtgccagcccaaagttatcaaacctcgaatggcagaagtatcgatatgtttttatagcaaatctattatttatttatcaggctcctcttgcccatgactagcgtcagtgctaaatggttatagagcaattagaacaacgtgtggcaaatattaataaacaaaacaataagtatctccctcccttttctccctcctcccgtctttttcctgtatttaggttttcattcataagagaggccattatctgaaagccgaatagaaggagtttaccaggtaaaaagaagtacagcaaagacacaagaagtttccactagtggcacatgaaagcaatgagtcattccaatattttagattaggtgggtggttccaatctcctgagacttagtctctgggctttcactagcagcggtgtacttaggatcagggtaatgctggaataaggagggtttctatggtggcatagaagcagaaagaaggagcatcaaaatcagaactggaatagggttgaggggcaaggaagaatggtggaaaggggacctggaaggtacattagtccctccaaccctcacctcaggtccctcagaataaatagagaactctctctcctcttgtcctaaggggaaattctctccactctattgtggtgctgtgtggtagaggccatgtcagacctggggattgcccagtctcacaggcatcttcacccaagcttttcaacaagcaacaaaagtgtcagcttagaatgctttttctgattggctaaaacctcatttgaaatgctctggctcaggcttctgtcagctgcttccccctgagccagtcaacattctctacattctctagagctctctgtgctactcatagcttaccccattacccagggtagccattgcccaactgccctgagaggaaggcaactcagacacatgattcagggccttatctgaggtaccccaccctgggtaccacatcaggtggatgtgggcacttaggatgaaggcagtgtgtatcccatgtggttagaagatgagatcaagaaatagtcatgaaacaggtcaaggttccagtaaagagactctccctaggggacatcctctgttccctcaggatggaagataaaaggtatggactctttctttgtggaccatcagagagaaatcatcgtccctgatcagcatctcttggaatctatgctttgtcagtggagttaattgtgaacataataataacaatcaccttgtgaccagaagggccatctgggatcctagatacatttaattcaggaattaaaaaataatgtagggatccctgggttgctcagcggtttagctcctgcctttggccaagggcatgattctggagtcccggattgagtcccacgttgggctcctggcagggagcctacttctccctctgcctgtgtctctgcctctctctctctacgtctatcatgaataaataaataaaatcttttacaaaaataatgtatattctgaaatattctgtgacttccttaatgccagtagtaatataattagaaatactgccccacaatattatttcccttttaataaaaatttatctagcaattatccctaagtttttccaaatctttgtaaaggtactctttacatcaacccttacatcccagaatatgggatgtcccttacatcaacccaaaatatgaattttccatcacacatatgcagtagacccctgttcttagcatagttatctctttaaaatcacatcctagtaatctggtcaaggaatgaaatcagtagcaggttggccatggataaacctttcaactctgaaagatttagttttccttatttgtagaaagaataaacacctcactggaacaccatcatgaacgtaggtataatttattcaagtcctctgtaaactatgctgagatacatacaaaatagtttctaatataatagtgagctcattgtcttaacatcattaacaaagacagaaaattcttctcgtgatgtctcatctctcttcagatgacagaatcattatagttctgaatatatagttctgaatccctgcctcttacctcatcataatgaagagaaagagaacaggaagtatagtagatgtatttaactttgcatcggctacatgttccctctctgaaatgcatgaatacaactgaacagaactaccatttcagctataatttcaagtctcagaatctggtcctcctctcagtgttctcacaaatgtggaaacttgagtgcaaaacagagtctcaatacaaactgactaaaaaagaagacagtgaatacagctttgtgagctgcatgtaccattatggcactcatctaggcttgactgagaggaggagagactggcttcttattgttacttctgacaattgtctaaaagccccatcctatgccacatgcccgagtgccctctattcctcaccttcatgatcactagtccccctgtgtctgagctctgacacatacatttatgtagtttcatttccagtagttctgtctctcttcctcaacatccaacagatctcatatggtgagtactatcacttaatattttttatacacctacaaagataaggtcctaggtttcataggtgcaaatacatggatcctaccttctaagagttcacacattggaggggacaggtatgtggagaaaaataaaagggaaaagtttgcaacagccactgaagggcaatgtgaaatacagctgactaaaggcaggacccaaagtgctgaagattcaagggactcttaaaactataaaatgaaaatggtgcccattggttcagttagttattttttttctcttggaaaggattggcaacataggactagatgatgattatttgtggattaattttaattcatgaataatagttttttaagatgaagatgaagagttgatggtggagaggtaatgagagagttgaaagccaagcttttcaggtgtgattcttagaggaggtgatggctcagcagatgaagggctatgttcatttcaggcaaaaaggcttacatgagtgcaggggttgggaaggacactcaaagtatatggtttggtgtgaacaaaggtgggattcagttaccctggtccttgtgaggtttgatggcagcaccattcaaagttgtcttggttttcctcacagtacaacaggaaaaaatagagggaatttaagcagaggagtaccattacatgcatgtccattcataaagtgaccttggaagcagcctggaggacttttcagaggatctgtacattaccttttaccatccagaaaggatccaggttaatctgatgaacccaatccaccgaaatccagtttactgaggaacaaatttgccaatggtcaggttgctaagttggccaaatttattaatgtgccccaaacttatttctttttttcctatttctaaagtttgtagatactcatagtgacgtgttgctgtgatctgtgtactcctgctgtctaagctccactccaactttctgctgacacaatactcccatgaagcttaataagaaatgcatttatatagacaaaatgaaaactggtcaattacatttctgtccgactactaagtggctcctttcaaaatgaggcagatatcaatgttctaatacaaaagcctctctctcagttgcaaaaagtaaattacatgctatattatgatgtgtgttaacaatgaagacctgtacagatgagagatggagatagatggattttgcttccacatgtttagaatatttcgggaaggataagcattaagtactagcagtacttacctcctcagagacacataatggctgtatgtttgttttctgagaaagaaaccttctactgtgttgtacctttgtagcaattttttttaatcatgaacatgcattagcaatccaaaattgaatttataatcaagccaaaaatgatggggaaaatttaaattagaatataacccttttagtggtttctaatggaccagtctcacgtgaaatgatcctcattttttttgccttagaattatcataagctgtaagacaggatcttgtgaaaacattcaagctgatgatgatgctaaattagcagctagggtatgtgtctcaactttagaccatattaatcctcctgtccacccttcaccccattcttcaaagcaggttcctttttccctggcctctgtttctttcttgttctaaatccagaacatgggctttcctttcactgacatactaccttaattttatattgatcacatcaattgtgattattttgaaagcatcttataaaaagactaccttgttggatgtcatgttcaattctgggtactctgtcctatgccttgtattgatattacttcaaaattatatatacctatattcttcatacttgtggcaaattattatgttgtagatcagcctaaaaatgttgcaaatcaaaacttactataagaagttgggaagaaaggcttcagttggaagtgaatacataaaactagcagcctggacacttagcacaagaggaacaaagactgcgtgactttttttatcgcaagcctggctcatagagggggggagggttgcattggctgaaggaagtggttactagaacaaggcataaccaaagatggaatgttgcttaaaaaaacatcactgaggctgtgtttgagttaaatcattaaatactctccagacaatgggccagtgatgtgagatagcatcacttgtctctggcagaccaagccactaagtctgttagagaaaaaaattacttataagagcaaaaaacatacaaaactcaaaggtttgatttgccatcttctacctgtatattgcattaagtattgccttacctctgaggtcattttttccctctttgttcattgagcccttctttatcacattggtggatttccctaaaatatcttctcttcattggttattagttcacactttgaaatgaggcacagaagtgtggctgaagagactgtagcagtaagaggcttatgaaagatgcgctttgggcttacttggctgacaattcactgacaatatcataatatggaatttctctcttgaggtgactcatatccaaaaagcaaatttctggtgtctcagttgtgggggcagagcaagtgtatggtaaataaatggctgcccatgttccattgtaggggaaggccaggggttcaataaagatgctaatggtactttcaattaattcccaccagtgtacacaatttaaaggactaaataaatgaatcatagcacgattatatatatagactttcaaaacaatgttttagaaggacatttagtgacagaattgtttatcatatgttaaatttaaaagtagttacaaattagcctattcaatatgatcttaggcctctaaacatgtttctatttatatctctatttattatcttcaaagcctagaaggaaaaaaatgtcactcaaggacctagaatacagtaaagataatctcattttctcttctcctgcttcaaatattgactgacaaatctattctggttggctttaaaaacagatcagaaaaaacaaaaacaaaaacaaaaacaaaaaaacagatcagttagggatgcctgggtggctcatcagttgagcacctgccttcagtccagggcatgatcctggagtcctgggatcgagtcccacattggggtgcttgtatgaggcctgcttcgccctttgcttgtgtctctgcctctctctctgtgtgtctttcatgaataaaaaaataaaacttcaaaaaataaataaaaaataaataaagacacaaaagttaaatgagatctgcatgtggagctattagttaaaataataggctgaatcttaaagttaagtaaacaactattctgtacctttgttcatctccaccaagcttgtggtaccacgtatcatcagggcaacacaactacagctctcagttttatttgacctgctaaacacacttaatattttatttatttatttatttatttatttatttatttatttatttattttacttttcttttgattccagtgtagttaacatactgtgttatactacttgaaggcccacaatgtagtgattctatacattactcagtgctcatcacaataattgtactcttaatccccttacctatttcacccattctccactcacctgccttctggcaaccaccagtttgttctttatattcaagagtctgtttttaatctttgtcctttgttttctttccttgttttgtttcttaaattccacatatgagggaaatcatatgatatttgtctttctgtttgacaaaatggtttcaaaatgattaaagatctcagtgtgagaaggggatgaggcaactgggtgatggacactaaggaaggcacttgatgggatgagcactgggtgttatactatatgttggcaaattgaatttaaataaaatataaaaaaagtaaagatctaagtgtgagaaatgaaaccacaaagttcctagaaaaaaacataggcagtaagctctttgacatcagtcataagaacagttttctagatatgtatcctttgcagggaaacaaaagtaagaataaactattttgagtataccaaaatgaaaggcttttgcacagcaaaggagacatcaacaaaactcaaagtcaacccattgaatgggagaagatatttgcaaatggtatatctgctaaaggattagtatctaaattatgtaaaaaaaaaaaaatgtacacaactcaacacaaaagagcccccaaataatccaattaaaaacagaattcatgggacagcccaggtggctcagcggtttagtgccgactttagcccagggcctgatcctggagacccgggatcaagtcccacgtcgggcatcctgcgtggagcctgcttctccctctgcctgtctctgcctctctttctctctctctgtgtctctcatgaataaataaataaaatcttaaaaaaaaaaaaaagacagaagacatgaagagacatttcttcaaagaagatatacagatggctaacagacacatgaaacaatgctcaacatcaacttatttacaaagaaatgcaaatcaaaactacactgaaatatcacctcacacctgtcagaataactaaattcaactatacaagaaacatcaagtgttgggaaggatgtggagaaaaaggaaccctggtgaactattggtgagaatgcaaactgctgcagccactgttgaaaacagtatggaagctcttcaaaaaattaaaaataaaattaccatatgatccaccaattctactagcaggtatctagccacataaagataaaatttttaattattccagaagaataatttcctaatatggccaaaccatattaactaattaatctcccgtctgctctaccatcagataaccactacaaccactttaatgtatatttcagtctttttcccaaaacatatatatttctatttgttttaaagtgagtttataatgtagaatattttatttgcatagtttgcttaactctatgtttcaaatatttcccccatatccccatttattctttctctataagtgttctaaggtctgaataattattcatgaagacctgtgccatcgttctgtctgccataatttattatgctaatgtggagcatgttttattaattacacttgttatttggaataattgtagacccacatgaagttgtaacaagaaatacagaggcatcttgtgtaccatttacataatttagtcaaatggtaactactttaaaaattacactacaataccacaaccagaagattcccaatgatacagtcctgatacagaacatttccataatcacaaagatcccctatattgccctgttataaccacatctacttcccttccatcccccacacccatacccaaccctcaccttaaactttggcaaatacaaacttgtgcttcatttttataattttttccatttctaatttcttatacaaagagattaactcacaacagtatgaaatataaagaagtctactgacatgctcccgaaagaaattaacgaaacttaagttttagaaaaattaaagtcactggctcaaaggttaggggaaaacaggaaatgataaaatatttattcaagaaaatctataaaagatcagtaagaaaaaagggagtctgtggtatttcaaaagaaacactggcggtgtagcaaggcagagacttcactccagattgttgcagccaagaacaaaggattctgactcccccaagatccaagccagtggatcttcttcccaggagaagcaggacttcaacataactctttccgtcttcaattatctgttgccgaggcaaagtcccaaatgagtgtagtctagaggtgggaagtctcatcttctgcccaaccaccatttgttgggaatggaaaatctaccttgagtgtgacatgctgagaatactgcgtgcccccccgcccccgcccgccccactagccctttccttgactaataatgtggtgatttcatgacagaagactcaagccaggagagcttccagctgttggccactacctgtaccatgtgctctgcccttagagaggagatgtcactcaaagagaagcttaccattgtccccacacctagttccatagtcctagctcaaatattttaccggaggtgagagataggctataaaacaaatacctcctataatagtccttaagaaagtgacttcacttgcaacagagaatggagaatagtttaaaccaaagacaatccccaaaactgtagagattgggatgaaaggaaatggggaggagattcatgcatctaatgaagatacaccatagactgtaggttagccagtttgcaggtaagaactgggaataagtcccttgagaggagtcctccttgggtcagaacaaatatcaaccactgacctcaaaaactgtttcatagaaagactcacaatcttattaaattagattgtagagaaattatgccccaaggcactactaaaagcaatggcaattagtagaatttaacagctggatgtggtgaggaaaagagtggaagagtccttatcagtaccattgtcattccaaggtaactgtgctgcatctccttaaggagcataggcttagctctatggggtgaaggaaggaaaacacacatcacaaagaatccaaccaatcattatacaaataattatacaaatcattatacaaataacaagctccagggaggcaaggatagtatccaaagatgtcatatttcctaatatatacagtttcccaaaaaattatgagacatgtgaaaaatagaaagtatgaccaatgcatcagaaaaaaaagaaggcaggagcacctggtgggctcagtccgtggagcatgtgactcttaatctagaagtcataaattcaagccccatattgagcatagagattatttaaaaataaaatcttaaaaaaagaaagaaagtaattgaaactgcctatgagaataaccagatcctgggtttaatagtaaaagattttgaagtagccatttacaactaggttcatagacataactgaaagtatgattgcaaagtaaaagaagatatagtgataatgtagtgtcaaagagagaatatcaataaagatgaaaactatttaaaaaaaaacaaaaattttctggagctgaaaagtacaatgactaaaataagaaatcattagagggatttaacagttagaaaacataggtattgaacttgaggaggtatcaatagaaattatgcaaaagaaagaaagaaagaaaatgaaaggaaaggaaaagaaaagaaaaaagaaaagaaaagaaagaaaagaaaagaaaagaaaaagaatgaacagatatgaagagagcctcagtaaaatgtgggacaccattaaatgcgtcatcttatatataatggaaatatctgtaggaaaagagagaaagaagaaaattattcaaagaaattatagctgaaaacttcccaaatttgttgaataataatatcctacacatacaggaaggttgactgactccatgtagaataaatataaagagagccacagacacattagagtaaaaaaatgtagaaagtcaatgacaaggagaacattttgaaagcaacaagaaaatataatgatccattgctcacaagaaaacaccaataaagtcaacagcttacttatcattaggaataatacaagccataatgaactaagataacaaagtgttcaaagagaaaaaaactatcaacaaagaatcctatatccagaaagctatcactcaacaatgaagaaaaaataaaagctttaccagataatcaagaactgagagaatttgtctctagattttttttacagtaaatactacagaaaattcctcatgtgaaagcaaggactagagatagttatttggatccacacaaagagcactgctaaagaaaattatggaattatgaaagacactaaatgcatattttctcaatttttcctttaactggtttaaaagaaatacataaaataatatacatataatatactacggagtctataatgtataaacatatgtgtgtgtatatatacatatatatatatatatatatatatatatatatatatatacagtcaaaacagcaaaaggaagtaggagggagcaaagctatagtgttctaaggaaatgataatggatgataaataattataacaacctactgttggttttgcaatgttaatagatgtaatacatataataataccacataaaaagcataaaggaacagagatttgtagaaagaagatatataaatgtgtatatatatgtttatatgtttatatatatttctcaaattaagctaccatatactgaatagataaaatatagatataactcacaaaattaaaacgctacattagaaaatatttactcaatataaaagtatagtagatgtagaggtacaatagagggacaaaaagatacaccacaaggaaaacaaaagagtcatggtgcctgggtggctctattggttaaacacctgtcttcagctcaggtcatgatcccaggttcctgggatttagccccatgtcaggctcccaaattagtggagagtctgcttctccctctccctgtctgcttgcttgttctctctctctctctaataaataaatcaataaattttttaaaaagaaaaaaaaatagagtaagtagcagaagtactttcaactatataaaaaaagacatcaaatgtgaatggatttaataatctatcaaaaggcagagattagggcagcctgggtggctcagcggtttagcactgccttcagcccagggcctgatcctggagacccgggatcgagtcctgcattgggctccctgtgtggagcctgcttctccctctgcctgtgtctctgcctctctctctctctctctcatgaataaataagtaaaatatttttttaaaaaagacatagcaagcaatactttgaggtaaaaaaaaatgaagacaacaatataccacaccttatgggacacagttacaacagtgccaagaggggactttatagctgtaaacgcctatattaagaaaggaggaatcatttttaatcagtaatttaaccatgcatcttagacatatgtgacaaagcccacagttagcatcatactcaatgatgaaaagttaaaagattttcctctaagatcaggaacacgacaaggatgcccattcttgctatctcatttaaaacgaatactgaaagtcccagttagagcagtaagtcaataaataaataaacaaacaaacaagcaaataaataataagaagaaataaaaagtacctaaaccagaaaggaggaagtgaagcaaacactatttataataacataatctttgatatagaaattcctgaagaccctaccaaaaactgttagaactatgaaatgaattaagtaaatttgcaggacacaaaatgaatgtatagcaataagctgcaatttctatacagtaataaggaactatctgaaatagaaatagaaagaacaacccaatttacaaagcatctaaagcaataaaatacatagaaataaatttaaccaaggaatttaaagaactgtactctagaagctataagacactgatgaaagaaattgaagaagatgcagataaatggaaagataatttcatattcttggactggaagaattaatattataaaaatatatccatactacccaaagtgatctacaaatccaaagtaatctcattcaaaactccaatggcaaaaacaaaaacaaaaaaaacctttccaatggcacttttcatagaaatagaaaaaaataatcctaaaatatgtatggaaacaaaagactccaaatagccaaggtcattctgagaaacaacaaagctgaaggcatcacatttcctgttttctagctgtattacaaaactgtagtaatcaaaacactatgatactggcagaaaaataggcacatagatcaatggaatggaatagagagcctagatgtaccttacacatatacagtcaactcatatttgacaaagatgtcaagaacacacaatgaggaagacattctgttcaattactggtcttgggaaaactggtatccacatacaaagaatgaaattgggtccctaacctacaccaatcacataaatgaactagaaatgtatcaaagacttaaatataagacttgaaactataaagctcctagaagaaaacttagtaaaacagatatttgacattcgtttttgcaatgatttcttggataaaacatcaaaaacataggaaataaaaactaaaataagtatttaggactacattaaactaaagagctctacaaggcaaaggaaaccatcaatacattgaaaaaaccacctacgatatgagagaaaatattcacaatgcatatatatctgataagaggttaaccaaaacatataaattatagaactcatacaactcaaaacaaacaaacaagcaaacaaatgttctcattataagataggaaaagtactggaacacatttttgcaagaagacatacaaatgaccaataggtatataaaacctatgtaatagtaatcatcagagagatgcaaatcaaaatcacaatgagatatcacctcacacctgttataataactgttactaaaaagaccagagataaatgttggtgaggatatggaggaaaggaacccttctacactattggttggaaagcaagatggtagcaccattatggaaaacagtatggtggttctttaaaaaattaaaattcacctaccatatgattcagcaatcctactcttgggtacatatctgaagtaattgaaatcagtatccctaagagatattgtacactcattcatcgcaggactattcatgaaagcaggatagcaaacaacataaatgtccttcaactgatggatggataaagaaatgtatatactggaatccctgggtggcgcagcggtttggcgcctgcctttggcccggggcttgatcctggagacccgggatcgaatcccacatccggctccctgcgtgaagcctgcttctccctctgcctgtgtctctacctctctgtctctctctgtgtgactatcatgaataaattaaaaaaatcttcaaaaaaaaaatgtatatactcacaacagaatattactcagccatcaaaaacgatatctggtcactttgacaacatggatggaccttcagagtattatgctaattgaaaataatcagggacaaacaaaaatgccaagctcatattacagagaacagattggtgattgccagaggcagggcatagagagtggtgaaatggtttatggggtcaaagatactaaattccaggtttttaaaaaatgaataacagagttgtaatgtatggcatgctggctatagttcagtacagagtactgcacacttgaaagttaagtagaaattttaaagttttcatcagaagaaaaagaatatttgggatccctgggtagcgcagcggtttggcgcctgcctttggcccagggcgcaatcctggagacccgggatcgaatcccacatctggctccctgcgtggagcctgcttctccctctgcctgtgtttctgcctctctctctctctctctctctgtgactatcataaataaataaataaaatctttaaaaaaaaaagaatatttgtaattatgtatggtgaccaatgttacgagatttattatggtcctcattttgtaatatgtacagatgttgaaacattatgctgtgtacctgaaattaagatgttatatgtcaattatatatcaactttttaaaaaggcaataatatgaacatgaatatacaaataaatcagataatttggataaactggactaattctcaaaattacaaacgagcaaaactgaatcaagaagaaagagcaatacgaaataaccaaattctatcatggaaaaggtttttagaaactttctcagaatctcttcaccatttgccaggaatgcatgcaggcttcctgggaaggatatgttcccatcaaaatgttcagattaggaaaagacaacagtgcctttcaccgaattactggacacagtgcagcagatcgccccaaagcaacccagcaagctcagtcatgtccttcattttccccatgtgatatagtaagaactctcatattaaggaaccctcaataactgaggtaattagtagagaaatttatccttggctagggtgagcagagtctccagttgatcagaaggccccttttagtaaacaagggaatagagagatgcttcttctcagtgtccaagggtcagaaaggattcataatactacatttaaatttaaagagaggaactggaccagaacaaagagattacagaacttgcaagcttactggatgatgcctcagcaagagtgagaaagatacaacaaactgtaatagagaaaatccaggacagctgcaagtgaacctttcatggtaccaatctcgtttaaagctccttaatgtcatgtatctttagtcagcaccagcaaagaacaggtatatgaatgggtagtgagatatactacctcactgataaatgtgcatagcaatacaaaatcctattcttagacttcagttcccacattgttcttgagtcagtagcaatggaaaccagcttggctcaaattaccagctcgtgcatttagaaaatctataatacagggcaaatgagggctgatttatcagatttgccattggctaaatagtaagagtggagggagaggagggtgctggataatttagcccaggccctaaagagctatgtgttctagaaaacacacaggtgcccttactgatggccagcatgtattcatatgctcacctccagcaggggatcctttactgcccagaccctgagttgacagtcaacagggttcccatctctgttcaggggtgggctctacaggcccagcctcctggttaatgtagtctttacctttccagcacagtctctcagatgttgagacagtggccctaaggctgtctggcccagagctgaacacactctcactattgggccaaacaatcccagattctacttattgtaatgggcatccccaatgcgtttagaaaattttgcagtgtggttattaatatgttggattcagaggcctggaagctgttctgtaaagtacagtgtttaactgaaaattgccttcacagttgggagtagtagcctacactccttggatgtctttacttacagtttgccctgatggtcctcacctcttttgtgaaacctttggagaatcgaccaaagactacgttattgtctaaaatttacattgaaaacgtcagaaaaaacagtaacaccctggatggttgttggaagggagaagctgtctgggcataggaagcagttattagaccagggttgaggtagaagaggaaggatgatgacatcaatctttgcagagcccacatttacatgaaaccatgatacgctattaaatacatttcctcccagctcacaaggcaaatgagggaagccagcgtcatttgtctctggtttagtctcccactaaaccgtcaagaaggcacacccaaacctgtggtggcagacagagcaggggagagaaattctattaacatctcagttcagaaaaatcggtgtatgcatcggtgtatgctgtttatggagcatcgtgcagaatttctgaagttactgtccatgccatacccactgggactcccctgcctttcttctctcccacaggatgtcatggtcccccagggatcatggccacaaagtttctgaacttggttgggctcccgcccactttgcaatccttgtatagatcttagtcatttctatctctcatttcccttcaccgtgtgcctttttgatccactcacttcagagaactaaaagaattactcctttgtacctcccagatacaaagaagaaaaacatgaacactcctcaaatccaataaagccttaaattcagaacccatgaacactgctgacgttcctttccctgcaaaaggaaactttcagaagaaaggcccggtctggagtgaaggcacagcaacttttgttgaaacttctgtgattggcgggaagccttgactctggctgcagttagcaatggtctcagcacaggaacacttgttgggattttgatgaagctggagagtggtttggcctccaagagtttgaacctagtctagtctgactgaatacaacttcagaatcttcagctgagcatggatgtctccaaaacatatcatctctttaaagaacccttagtaaatgacactagaactgaccaggagtgttcatccatgcacgcatgaacaaaatgctgtcaggtatgagaaacagagagaggaggaagagctcttttctacccccaaggtgcccaggcttatcgtggtaaaacactgccaggtggaggcactggaaggtgtacatatgtggcccgaggtctaagcaattcgttctttaggagaatttgtggcctagtgcctgtgaggggaagtgtgcacaaatgtccttctggttcacagtgcagcacagctgcccctccagcacatcaccctgaggttagattgcctgagtttgaattctggcaccactccttcctgatggtacagccttaggcaatgtccatgctacaatttccttgctggtataatgggaaagggagatgataataatatgcctacctcatggtatcatgaagatgaagacagttagtataggaaaagcacttacaagagtgtctggcatatagaaagcactctgcaaacattatacattattatgattattattatcactatttttatcaattaattatcaggtctcaagggtaacctggcaatctgtattattctctcactagcctgtttgatcgggatccaatacctccgggaggaaactcacagtgtcaaagctaaaatagcctggctttctttacattaggtgggaagggaaggaaggaaggagtgggagggaacagccattcatgctttaggtcctgccattgccctactcacctccaggatactaaccagcaataagacaggtaagcaaagggttggatccacctcctctctctctccctcctaatttccgttccaccacttacatgtcccagaaagtgttggttgactctgaaactgcaagaatcaggcttacacctgattgattcaggtcaaatgtgtagttgatttgggggtttattggcagatcggtgagcagagggtatcctgaaactgagcaaacatagttaaataaagcttcctctgcgtttcgagaagtggaaacactttaagatgtcagtattaatagctgtcattaccctaccaacctatgattgtgagcccacccttggtttaagggcagacgtggttgtgacctagatcagaggggtaatatgtattccctcatctgattgctgagccctttgcttttctttgcatatggaacatttttctcaatagagaagcagagcactttgaaaggcacacccatattctatgtgctatgacatttcttcacctaaatctgcaattctataacccagttctctctagccaggctgtgctgacaatctttgtggacattgggtttaagtgaaaccaatataagacattgggtgcgttcctctcagacaaatgaaaaccgcatgggaggcagcatcattggtctctggcagactaagccacgaaggagcataagaaaaaaaatatttagatgtatgagaagaaaaaagtattcattataaagaagagcaaaaaagccaaatttctaaatcatatatttaacaaaggatctaaagagtcaccagagtaaacattacaaaacttctgggaacaccaaagatgaaaagtgcagcagaatgcaatgttcacagcgagggttataaaatatggatttaatgcaatttccatcaagatacacatgacagcctaaaaattaataatgggtttccaaaagtgcatatttaaaatactcacaaataactaaacaagtaaatgtactgagtactttttataaataattagcttttgtctccactgtactgcttaatttataaaaatactgcttctttttggaaatattttgttcttcctctatggtgatgatttattccattgtctctgatttcaggactaataatttccatttggcctaaagagataagtcctggagacagatttaggatacccagggaagagaaaaacacatccagagtggctttgcagccctgccttgctctgtttgactcccactccaccaccaccatatgcccacaaagagaatatcagctaaagaagaactaagagcatttgcagaagtcctgtttaagtgacacagcaatttgacattgaacacattctcttcagccaatgaggatcagatgtagtgtgacatcacttgtctctggaaaaaaaagccgtcaagaatactcacaggaatagagctactgcatagagaaaagtacctttctcacaataccaccaaaatctaaaaagtaggaaacaaaaggtataacaactttactaatttatttagtgtaacatgaaaagctaagagaaaaaatggaagtcaaatataacataaaattctaaaattacaatgtaaatctaaaattctctaggaatgatgaacaagcagaactaaggaagaactcttgtcttttcctgatcttactacataccttataattactcttctcacccacactgtttaatctacctaagtatttccttctttcagcatgcatttcctttacctaaggagacaatactttcccccatactctgtagtctgaggagataagatacttcctcaagtcagtagttggaaagagacacattgaggcataaaggaacattccccatcaataaaaaaggcaggcgagctttcatggtgtctgcatttatcatccaaatgacatggacacttgagtggtaaatttcatcttaattctgattgtacacttacagtctcttgtcacctcacagcctgccagcaatggcagtggtgtatgccaaggtatttgagaaatacaaagctggataaaagccttctcaaaagtctaggatgacctcagcacacttgtagcctggacagggaccctgagaaacgtatctactctccccacactagaagcacatgctttcacctacaaaaacttgcctcatcattctcttagaacacctctgccgaggttttcaaagaatgaagctcttccagatttatgtcagcttgtattcagttatctgaaggatcaccaatctctcctcttcagctgcaaaaatctgaatggctttataaaacaagagatttcattacattcattatattaatccatggcaggggtgggtggagaatgagaaaataaattcccatattttagtagatgacatcacctgtttttatgtgatttgagctgcaaggacactggatcattgctaattgggctgtatgctatcccatcatatccctaaagtttaattctctaaggtttttttcttttttgaaaattgttttggctatcccagatcctttgcatatctatataaatttatttagtgcagcaatttctacagaggaaaaagaaggaggaggaaggatcctgttgagatattgattgactccataaactgacttgagagaattaacctcttaaaaacattgaagatttaaattcattatatatatgtattacatataatatatatatatatatatcaatgttttagatcttttaaattttactcagttgtattttgtgggtcttggattagaggtcttccatattttttattataattatattatgcattttgatagttatgattttgattgtttttccatttttaaattaaaaatatatatatagagagagagaaattcaccctttttaattcacaattctgtgaggtttgacaaatgtatataatcatgtaagcaccaccatgatcaatatataaaatagtttcattattccaaaatatttccttgtacccccttgtagtcaaccccttctctatccttataatttgcttttgtaaaaatgtcatataaatggaattatacagtataggatttagagtctggcttcttgcatatagcatagtgacatgaaactaatcatgatgttgcatgaatctttagtttgttcctttttagtgttgaaagttattccattatatgaatgtaagatgatttatttacccatttcttaactgcgaaacatttgtgttatttctagatttgctgattaaaaattaagcagctttactttcttctagaggttttattttaagttgacctttagctctataatttaatttttgtatgagatatgagtaacagatcaaaatttattattttgcacatggatatccaattttccagtaccatttgttgaaaagtctatccttcattgacatgtttttgcacttatgccaaaaatcagttgactacatatatatgtggacctaatttgagactgctcttttttactgttcatatgcctgtcctttcaccaatacaatactgtcttactttagtgttagaataaatctggcaatcagggaacatgagtcttccaactctgttttgctttttcaaaaatgttttgcctattttcttctcttttatttgcatttccatataaattttagaattcctttgtcagcttgtacaaaaaaaaaaaaaaaaaatcctgctgagaatttaaatagaaagacactgaatctatagatcaaatgaagagattgacaccttagtcatcttatcaagaaacagggtattttacatcctggatttctttcatgcagatttgtatgttatataagacttagagttaactattttataggctttagtgctatgtaaatggtacttattttattcttaagtgtttaatgcaagtaaatagaaataaactcaatatttgtatattgatcttgaaactctgaccgtgctaaactcatctactgtagtaaattttatagattctgttgtgcccaagattgcaaatctgagaaaccacggaggagtcgaggagcccacacaggtgcaagcccacgagggttgatttacaagctcgagcttgggtccaagtatacccgacacagtggagcagggacttggaccccgaggtgggttttagcttagttttaagggctggtctaggggaccttcagaagggctggagcaattcctcaagttctgtttacattctgatatggggctttcaagggcattgagctctgttctcattctaatatggggtttccttcccctgacttgggctctgttctcattctaatagaggcttcctgcccttggcttgggctctgtttttattctaatatgggactttctaggacgttaagctgtaagctgtttttttttcctgtaactcaagtaaggtaaagttcagctcttattcaccggggcctgggatggctgtacttgtgctaacgctgaatttagtggaatggccttaattttctcggcctccacagattctttgggattttatacgtagacaaatatattgtctacgaatacagatattttatttcctctcttccaatcggtatgccatttatttgtttgtttgttttgttttactgaactgattcttcattggagtggcaagagcaggtatccttgttttgtggccaattttagcaggaagcatttagtctttcacttttaatcatgctgctgattatacgttttttgtagataccatttatcaggctgaagacatgctgaaagtttttatcatgaaaagaggttatattctgtcaaatactttttctgtatctatttacatgattgcattgttagtgttctaattctattaaattgataagttacatcatatcatgatgaacaacctttgcattaatggatgaatcccacttaattatgatttatcttttctttattggattccatttgatagtatttgagagttcgtatatatatgcatatctatctatatatatacacatatatgtatatatagatatatatatacaccaactgttgtttgttcttcttgtaatatctgtcaggttttggtatcagggaaatattagactcataaaatgagttgggatatgttttctcttttcttaaattatggagaagtcctatagaattggtattatttatttcttcagtgtttggtaaaatttgccagtggagccatttgggcctagagttttctatattagaaagtttctaactaaaacttaaatttgtctaatagatttaaaagtattcctttttattttcttttttattatttcattttatagtgaaatatatttgatacataacattgtataagttgaaggtgtataacatgttaataaaacacatttacatatttaatgtgattgtcattgtatcaatgattagcatctcttctatcacattataaaattgcctttctttttaatggttggaatgataaagccctactctcttaataggttttgaacttagaaataaaacagctatttgactggcaaaatgagtttcttcaggaatagcagagaattgcaatttgggacaaaacaagatttggtaaaaactatcagctaggtcaacaaaaaaaggagaggaacattattttgtggaaaggaaggaggaagttgggaagggttgttttgaacaaaaatgcattgaagaaaaggaagaatgtaggtgatgacactcattggctgagctgctgggataatctgtttcttgtagaaggtgcaaggtacatcttttcctgttggagtctgtaattgattctctcctgttgagaattcggttatggtctataacaggcatcgggcggtactggtttgagcttccccttctatcctcccaactccattttagtgaggtttcttattattaatatttgtgtgttggatgattaaaatacaatattgttatctctattcactataccatgcattagatttactacttgttgccagtttgtaccctaaacaacatctgtcctatgccgccactcttatcccctggttactatatttttacttttcttacaagtgactttttagattccacgttgaagggatatcatacagtacttgctttctttgtctgacttatctcacttggcataatttgctcaaggtccatccacgtttttgcaaacggcaagatatctttctcatagctataatattccatatatatattatacgcacgcacacacacacacacacacacacacacacacaccgtctttatccattcttccattaatgggcactttggtggtttccatatcttgactattgtgaataaagctgcaataaatatgggagtggatatacctctttgatattctgtttcaatttcctttgggtatatacagagaatggaattgtggatcatatgatagttctacatttaattttttgaggaaactccatattgttttcatagtggatgaaccaatatgtatttctaccaacaatatacaagggttccctctgtccaccaccttgcccacacttattggtgttcttttttattttttttaagattttatttgtttgagagaaagaaagagagagagcaaaccgaagtgtggggagggggagagggagagaaagagagagggagaagcagactccctgctgagcaggaagcctgatgccaggctctatcccaggaccctgggatcaagacctgagcagaagacagatgttcaactgccagtcactcaggcactccatcttttgtgttcttgatgacagccattccagcatatgtaaggtgatatcttgtggttttgatttgcttttccctgatgattagtgatgctgagcatcttttcatgtacctgttagacatttggattgtttctttagaaaatgtctatttaattcctctactcacctttaaatcaacttgacatttctgttattgagttttgtgtattcttcatatattttggcattaattcctttttttttaagatttatttattcatgagagacacacactgagagagagaggcagagacataggcagagggagaagcaggctcctcacagggagccagatgcagaactccatcccggatcctgggatcacaacctgagtcaaaggcaggcgcccaaccactgagccacccaggcatcctggcattaactccttatttgatatatgatttacttaattttttcctgctctgatattgccttttcattctgttcattgtttcctttcctgtgcagaagcttttcagcttgatgtagtcccattttgttgattgctgtttttgttgtttgtgtttgagatgtcatgtccaaacacatattgccaaggcaaatggcaaggacattttcccctgttttcttctagggctttccatatatttttcttctgttctttgctggttaaattctcttgtggggcagccctggtggctcagcagtttagcaccatcttcagtctgggttgtgatcctggacacccaggattgagttccacctggggctccctgcaaggagcctgcttctccctctgcctgtgtctctgcctctctctctcgtgctctgtgtctctcatgaataaataaataaataaataaataaataaataaataaataaataatcttaaaaaaaaataaattctcttgtgatccaagaaaatatatgcactgtataaattcaatactttaacatttctgaggtttgttctattgtcagaatgtggtctctcttggggaatattccacatccatttgaaaaaatatgtattcttgatgttgtgggtgaagtgttttataaatgtactcaagttggttgatagtattgctcagctactccatagccttattgactttctgtttaatttttctatcaaatactcaaaaatgagtgtagggcctccaaccataattttggattttctttctcttttttctatcagcttttgtctcatatattttgaaactgtgtcattaagtatatacacacttagaattgttatgtctttgtggagaaataacccctttatcattaagggatatctcccttaatccctcataatattccttgttctgatatctactttttctagtattcacataattattccaactttctttggattttgtttacatggtatacctttctccatttacttttactgtggctatgtttatatttaagatgggttatttataaacagatgatagtttgatcgtgccatttttattcattcccataacctatcattgaatatatgtttatacgaagaacatttaatacaattattaaaatgattggattatttttgctaaatattttctattaattatattagatatgtgctcactttttattctttcctgcttacttttgggttatcagttgccctacaatttactgcatataaatatagtctatgttcaaattctaatgcaagaacttaatcagtgtactctaaatttccctctcccacttttttgtgcaactatgtcatacatgaagtggaaaaaaaatgcaaaagaaaaacttaaatctccttcctttctatagcccattgacaagttcctacaacagcccaagtgatcttcctctgggagctcagctatctcaatcaatgctgacactttgctaagggcaaaggcaaacttagcaaaccacctttttgcactgaagatgtcttaagaattctttcttggtgttggctccaaacactaacatttccacatcaatatactttactttttcaaatcccataaagacacaatgcattgctactatttttgctttacagagtctgttaccttatacaacaatgatccccccaagtgacatttgacgatgtctggagatattttctggtgtcacaactgggcggtaggttactgatatctaacgggcagagggcaggaatgttgctaaacagtctacagtgagcaggaaagattcctacaaaaaagaattatccatataactgtaacaaaacctacaaacttacagttataaaataaataagtcatcggatataatgtatagcatggtgactacagttaatcatttattcattaactgtaaatagtaaacttagtattatcaatagttaacgatgtattattgatgtggagaacaatggcaaaagaaatggagctaaagttaaatctccttataatttgcagcccattgacaaatacttgaggcagacagaataaaactctcctccaggactcccaatcctaatattaatgccttctagagaaaaacatctccagcatgaagatagtcaggcctccagaatcctgtaagtcttttttaacatatgaaaatcctttttaacacttcccttgtctttatctcccccaactccaaagtgtctagtcagtcactcctcccccttatgatgcagctctcttgacccacaggccctaatccatgccatatgaaaaacagttttttgcactaaaaactctcaaaaattttgtttttagcttttggttccggaaccttaccaacttcaaaccacagcattattaccaatgtattgatattatcaatattatcaatagtcaactattaatagttaacaaataaatgtatatttgaaagttgctaagagagtcgatcttaaaagttctcatcataagaaaagaatgtataattatgtatgttgagggatgttaactagatttactgtggtgatcattccacaatgtatacaaatatcaaatccttatgctatacaactgaagctaatataatgccgtgtgtcaattatctattggttaaaaaaaaaaatccttctcagtataccaatagttctatggttgagaaactttttttaatgagagaagaaagaaaagatgatttttctacttaaccttgatttatgcattttccaatgcttttcatttctttgtatgaaccaggtttctgtgtgatatcatatttctaccacatgaagaccctccctttatagaacattgcaaaaattccatggacttcaatcttcctgcatctcaaaggtaagaaggaatgcatgactctcaagtacacagagtgaaagaagagactgaatgggttttgggttcattctctccaccttctctctcttcagagcacactcttaagccctctcaattctatcatctctcaggtgcaagacacatcttttcttttaagaagacggtgttttgtccttgcctcaggctttccctaaacaatgttgttggaatcaactgctggattgattcttaagaagatgcaagatgccctcaacaataaccaatgggaaaccttgaaagagacaaggcttattacttacaaatcctggaaattacacagcatgcctaggaacatacagtgaggtcaagggtaggtctggggaggagcaaacctgggtcctgcctttactgatgctgagagtaggagcccagaggtttgaaaattcacttcaggttggtgaatttaaaacattagaggagaaattaaggcataggaagagaaaaaaggaaggagcagggagtcagttacctaaatcaactagatctctaaaataaacaaaataatcagagcgggacagttggctccttctctagtcttttggctggcagcctgttgattcaaattagcgtccacctaagccaagagagactgggagagaagagcttgcaggacttagtaatagtagcagaaagagtctataataatagagaaagtccggaagagcaacaaaccaaactaagtgaccggcagactcgaaacctggccaagatcctgctggtcacaccatggacgacccatgggaaagacggaggcacctcaagaagctggcttcagggacaggtaaagaggatgttcctggtccctgtcaggagcgccctaactaaactgaactaaactaaactgaacaaaaaccaatgtgcttattgcaaagaagagggcaactgggtgaaagactgccccaactaaagatttaaggcctctgccgagatcttgaagatggaggacctggaagattaggggagttggggttcagcacccctccccgagcccaaggtagctctcagagtggagggacaaccccttgaattcctagtggacactggggcacaacattccattttattacaaccccaagggaaattggctagcaagacttcatgggggcaaggggccatgggtgcaaggagctacgggcaccaaacagtactcagggactacccgaagaactgtggatctcggcatgggccgggtatcccattccttcatggtcatccctgagtgcccctacctgttgttaggtcgggatttgctcaccaagctaggggcacaaattcgcttccaccccaaaggggcaaaaatcctaaacaaagaggggcacccgattcaggtgcttgtcctgagtttagaagacgaatctcgtctccaccaaacaccctcagccccaatgagtgacattgactgttggctgcaggcatttccccaagcgtgggtagaaactgggggaattgggctctcccagcaccaaccggccatatacatagaactaaagccgggggcagaccctggcagggtccgacaataccccatgcccctcatctccctaacccagactgggacccccgctctgcgtgactgtcaagaaattttggcacaggtgcgtggaatcagagctgatctccaggaccagccactgctgaacgcagatgccacttggtacacggagggcagcaatttcgtccaagaaggaaccagatacatgggggcagccgtaaccacggaaacggagacccgatccgggggcaccgaccctgccggacaccaccaactatactgatgctgacttacactggatcaaacgcttgcctaagacccagtgcttgcgtggctggtggagggccgcagactccagcatcatcctgccaaaggaactaggacggcgagtcctgtccagagtgcatcggagtactcatatgggagcaaggaagatggaagacctcatacgacacgcaaagatcactattaaagactcttgagcaaagatccagcagattgtggcgagctgccatgcatgccagttaactaatgccaccgcccatggatctaacccggacacccggctccgggggactgcccaggagcctactgggaagtggacttcactgaggtaaaacctggaaaatatggatgcaagtattactagtgtttgtagatactttttcaggatggacagaggcatttcccaccaaacatgaaacagcacagaccgtgaccaagaaactgctgggagacatcttaccaaggtatggtttcctgttaagattggatcagacaacggcccaggattcttctctaaggtaacacagggagtggcactagtacttggggcagattggaagttacattgtgcatataggccccagagctcaggacaggtagagaggatgaacagaacattaaaggagaccttaactaattagccctggagactggcggggactgggtgactctcctcccctttgccctatatagggtgaggaactccccatataagatgggactgactccctatgagatcatgtttggtcttcctccacctgttatccccaatttaaaacctgaggtgcttgctccttttctccctgcaaatgttacaacgaacccatgagcaggtgtggcctaagctgagggccctctaggagactgagccacccctggatccccatggatatcggcggggtgactgggtgtatctgcggagataccaacaccagacgcttcaacctcgctggaagggaccctacattgtgatcctgaccactcccactgctctcaaggtagacaggattactccccgggtccactacacccacttcccaccggctgatccacacgctgttctcaaggactttgttccagaatggaaaagccaaccagacaaggacaatcccctaaagctaagactgcactgttctcacttatttccctcctccaagactccctagtctgaggttgtccttcttcactgggacgtaaacgggaatgagaacagcaacaaggttggttcgaatcctggtttaatcattccccatggctcactctgagaccaacctggacccttgattgggtccttccttaggttcctctgagagggggaaatatggatgctgagaaaattaaggccattccaccttaagttcagcattagccctggagcattagccatctcaggcctctgtgaacaagagctgaactttaccttacttcagtgaagccctatattagaatgagaacagagctcaatgcccatggcaaaaagtcccatatcagaatgagaacagagcttaatgcccttgaaaacccatatcagaatgtaaacagaacttgagaaattcctccacggacgtcccctagaccagcccttaaaagtaagctggaacccacctcggggtccaagtccctgctctgctgtgtggggtatacttgatcccaaattagagcttgttaataaaccctcacgtgtttgcatcggtgtcggctccttggtggtttctcggattcacaatcttgggcacaacattttcagacagaggtaacaagttagtttttgtcaaaaatggcacatcattcctctgaatctaattcacgaataattttacctgatgtcaaaattatgacctgaagacagaagtgactggaacaggttcattgtgtgactgcaggagatgagacacagagtctggttacaggcagagctcatcttcgcctagttaacgacatgggcttgcctgaacttctccatcccacaggatttgagatctgcagctggaccttggaacttcccatccaagatgcaattctgatccacatgattagcaccctaacttcctaatctgagttaaattttctttaaagatgatattagtaggcaatattctggagcctcatcaagaatggttttgtccatctgtcacagtcttaagtaattttggcaaagaaatagcaaagtttcaagacagcgaaagtaaaaccaatgaatcaaggaagtagaaattagtaaaaatttcttgtgcacaagtcaaaagacagtttgcacaccagaagtatttaaaccacaaggtgcaaggctcagggatagcttattataaggtagctatgtcatgagaaagcagtgactgtttaatcttcacaaggattggctacaatattcagttctcagtggttacctcatatcaaccatgggaaagagttcaatttcatttgtccttcccagaggcagaagcaagaaatccaattcaagatgaccttgcaaaataagctgaattacctttgtttgcatgattaaacttatgccttccaaaggtacaagcaagaaatgatcaggttcaagttagccttgcaaaataagctaaattaagctttgtttgtaaaatgtttgaggctggatgccatttgtttctgattttaacagtacagggcaggtaagtctggatccaagaagagcccagaaacatggtatctcctgcacagaaagaagaaatgaagcatgcctcagtgaaacctcaaaatccctcgtgatccataaaggcacagacttgaaagaataaatccaccgtagggtcaaatatctatcctaattatgttaggacctgtattctgaatccacacaggaaactccctcccctacaaagactcatgagtgacccttgtcattctgcagctctgcactcaccagctgtgggaccctgagcaaagtccttcacctttctgaaactcaatatcttccttgtaacgtgggggtgatcttcacatactgcaggtatagtgggagccccaggaatttttcattccaagtacagtatatatatatatatatattcctcacaacgttcagatgagatgctgtcaatgcctccagccaacgaccatcaggagcacacctgtgaatgaacaagttggtttaactgttcattgtcatgagggagaaaattcaccatggagaaaaatggggctctcagcttcatctctgctcttttttatcttaattaaagtctgtttcatgcccagcatggagtccaaaacggggcttgatttcacaaccctgagatcaagacctgagctgagatcaagagccagacgtttaatccactgagccatctgggtgcccacatctctgctcttaagactttacaactagttcgttcagtcatccagattacctaggaagatctctcttacttaacgtcaactctttatgtattttaatcacatctacaaaatatttttcagagcaatacccacattaacattgattgaataactgaggactataacctagccaccacataaaagtgacaatttaactaccataaggtttgggttggttttggtgattttgaggaggatttaagaaagagagactctctcttagttgctttgtcagaaagtagtggtgggatggaaggaaggaaggaagactagattgaggctaaagctctaacttgtaaggaagcggcagccagtcatgtcatctagggaagaggattgcttggtcacacacacaatgtttgtgttttgtctgtgttcagacgtggttactaagtggccttgttttctctctctctctctctctctctttttcctcttgatccattatggtcatcacagagtggctgatactgctgttctctctctctctctctctctctctctttttaaagattttactttatttattcatgagagacagagagagagagagagaggcagagacacaggcagagggagaagcaggctccatgcagggagcccgatgtgggactagatcccgggtctccaggatcatgccctgagccaaaggcaggcgctaaactgcttgatactgctgttctatgacatttttatgttcacctggaaaacaccagaacctggctgtgcgtagtacacctggttactagtaccaggtggctcccagatgccagagcttttcctgtctcagatttcctaccatctctgtcagtatagggtatgatagaatgttgagcaatagaaggtcatctaacaggcacagagtgattgattctaagtggaaacccctagtaacttatagcttccataacacagaaaatcgattcttctggaaaaaaaaaaaaaagatttccctctaagcactgccttcatcttcagctcaattcctagtccctcacaaatatctggagtatgtagcaggttaaagaatatgaaaagttccagaatgttctgagaacattttctaagtcacataaattccccctcattctaccttcaacatttgatttacattcttaaatgtaaaaaaaattttcaaaactaaaaatgagtgggaaaaattggaaagagtgacaaaacatgagagactcctaactctgagaaatgaacaaagggtggtggagggggaggtgagggggggaggtgagggggggatgcggtgactgggtgatgggcactgaggggggcacttgatgggatgagcactgggtgttatactatatattggcaaattgaacttcaataaaaaaatatttttttaaaaaaaaagaaaactaaaaataatagaatgaggcagcccaagtggtctttaatgtaatcaatgtcccaaattgcctttaaatgtaggcaggcagcactgaaacagagcgtgaagaatactcagggtagggaaaacatgaagttgacagatgatgcaattactgtaggcaccattaataacattatcacttcttttattgtcccagtgcaaatactggagcttttgagaacatgagaagagcttaattcaactggatttacgtaagtagaaaggcaaaggtgttccttggctatcgtcacaagaaatactctaggtgataaatcaaaatttggacaattttatatacagtatggaatcaaaaaagaaagataattaacccacatgtggacgccaggaaaagagagggagttagggatttttagggagaggaatccttttatgggagaatttttggaggctgtaacccagaaaagcctgaagaaaaccatgtaagtgataatgttatctatacatgaggctactcagtaattcccacccccttaccaccagcaagctatcatacccataggaatgtgttttaatacccttcctcctttcctagataattcccccaagtcactcagaatggaggctacctgagaaacaaggggatttcccaatcaccttcctgcttcctagtacatcctctaaaagtggctactgaagtgtcatcatagggattgtgtctgattggagggaacctgacctggcagggtttggtttagatgtctttagattcctttctcagttgggtcctcaccatcgctctgcaactcagaacagcaactgcggagaccacaccgagaaaaagatgaccctaaacagagttctgattttggggaccctcatcatgatgagcctctctggtggtgaagatattgtgggtgagtgcacacccgagggatgtggggactagtctagggaaaagaaattaaaggggaaatgagagaatggtataatatagtggagactcctcaaaggtgttctcaatactaagcagatctaaaaattatggtcattcttctttcacaaaactactgcccatgcagttgcagagttcatcaaaaatattattccatttggaatatcagatccagtaaatatagcctggagggcacaatggcattcatttatgattatctctaaggttagggatgtttccacagtggatgttttgttactaaatttcatgaacttttgttcccaaatatctctgaacaacattttgaagctctttataagtttttctgtagtctcacttggtataaagaatcccatgaattatgtatgttatgtagacataaagaagagtatcctctttgtcttatatttatatccatttttatgctgggaactggcatgaggatagtgggtatacaagtccagttgaatacctttagacaagtcattctaccacaagatgtcatatatgtcacatcagaaataatcaaatcaaatattcatttagaaatatgtttccaaaaaaaaaaaaaagaaatgtttccaattgtgatgacgtgtaaatgccaatgattatttttgtttcttaattgttactattacaagtgcagcttaatttttattattttaattccatataatagagtattatattagtttcaagtgtacaatattatgtttcaacaactctatacattactcagtgctcatcatgacatatgtatactcttaatcccttcacctatttcactcatcctccacccacctgccttctggtaaacatcagtttgttctgttacaagtctgttttttgatttgtctcttttttaatgcatttgttagttttgtttcttaaatttcacgaatgagtgaaatcatatggtagctgtctttctctgattatttcactttgcattatactctctagcttcatccatgttttacaaaaggcaagatttcattctttttatggctgaataatattccattgtacattcatatacacaccatgtcttctttatccattcatctatccatggagagttgggctgctttcataattttttttctttaacaaagtagagaatatctttatttttattttacaattgagaattttatgatggaagacttgcttaattaagttatattgtattcaaattatatgacctctcatctataaaatcgagacccttaaaagaaaaactggggaagcatacactaattacttaatccctaaggcccatctctcttcattgcccacctcttcccactttcttttcaggtattcttttatcatcctttccttccaggatctatctctggtcttttttattgttgttttattgacatgaagagtgggtttctaaaaatcaaagtagaaaaaagtcaagagttaagaggggaggtaaaatggagcatactctaatactcaccaactttgttaaccatgacttctcctattctaatttcacttggtggtttctcttgcttctccagagaatttccattttcctttcttcagtgtcttggttccttttttcaaacatgagtatatgcaattattctttccatctggtacttgtccaaggctgccatttgttgatgaacagggctgactgaaaccgattcacttctgtattttcagcatcagctgggtccacagtcctgcttagtgaggttccttctactttccttcatctttgaatccccaaaatttatctcactgtttgctcaaaagtgtgtaatgaatgtcaattgctattctccaggatcacagatatttgggttagtggaagttgatagacacagtgatagccaaaccatatggaagtgaatcaacagtgatcaaggctgtcttatgaccaaggataaaggctagaggattaagagggtttgatggagggccctttaagtaatcaaccaagagggggtcgtgctgggaaaggaagagagtgagttggatgaggcatagataaatctggaaagcaagacattgggatggagactataatgtggtcaaaacatgttcgatgagactaattaactaaaatgttgctaaccaaacaaacttcggaaaggaattggaggtacccaggaaatctgaaagataactttgttttaaggagacaacctctaaaaagaccaaggaacatacaagaagaatgtgttttggtttgactggcagatgagatatttgcagaggaagtgggagcataagactgctgctgttccctgcaggactcaccacagcgtactgtatttgttcctgtactcacttgactctcccaccacgcaataaactccttgaagacagaaaccatgctgatgggtgtttgactccctgctcctcatgatgtctgacatcttgctgatgttcagtaaatgaggaagagcataaggaggaaatgataaaaacctcacatatctctttacaaaattttctagttaggctcaccgggtggagtcatactgctgccattctactttggcatccttgcaaaatgcactgtccatttgaagagaagggccattctttaccaggagttctaaacagatagaaatgcaatgcagaataaggagagaagtttacaaggaaaaaaaaaaaaaaagagggatgaggagtgacagaaatctaaaatctaatgaatcttccattttgtacttctgaggaaatcaagtgctctcctctgaggattactattgttaacaaaacagagaccaaggaatattatttatttatttattatatactttgtaatgctgttgctgtccttgtcatactctttcttataccctaaaatagttaaaaattcttttaaaacaatacaatcctttgtgcttttctttgacaaaataagaaatagaagagggcacaggagagaggaggaggaagaaggaaggaaggaagcgttacctctgcagaaaatattctgctctgaaccagtcctggggggagagcaatcaaagtgtatgtgttattaactgatgaaagaattaagagataaaactgatgaagcagagagaagttaagtgaatttctgataaaggaagctatagccatgataatttattcattccttctttcatttcattgtaatatttatcataagtctactgcgcataccaggtgctgagctacacacacgggaagagcagcagcaagactgttgtaattgtgctctcacggagcatacacgatagtggaaaagcagagcgtattctgactggacaactaccaacacggagagagagggggcaggtgctgggaaacgtgcctaaagactgtgccaagaatgaagcgcatatttaaagtcaggttttctaagtcacctgtccccaccaaattacctagataactttcaaatcatcctgaaaacctacgaattcagcttgagatttaaagagagagcagctggaacgctatagtgagaagagttcacgcttccatcaaggtaggaagactggggttgggggtgggggggtgggggtggtaataaagaaacaaaaggcatccaagggggagggaccccacgaggggccgggcgaaggccacagcgagtgtccccaagacaggaaagccccctcccggagaggcaggagctgcaccaatcttcccgggtggaaaggggctcgcagggagttggagcaggaccccaggagggcgggatgccctcaggctcctgggacactaacaggcacctgcgctccgggaagagtgcgccacaccccacggccgagctccctaaagggctgcagtgcacgcccgcctggacccgggagcagctccggggcggctcgggcagaagctcctggcagacggagctgcgctaccgagagcgggattccagcagtgcaggtccgggagcccagggcgtgagggacacagcccaagatccgacgctcccccaggacaggcagaagccaggagggcccaggacagcaaggacactcctgccgccaggcggcctgaactatgcagatcagcggccccgcccggagcctccaggccctgcagacggggagctctgtagttactgcgggagctgactccagggctccagagctggccccgcgactgcggttgttcctcctggggcctcacagggtaaaaatcccccactgagcctcacagtggcctcaatggataaacagcttaaacatctttcaccgagcccagcaccaggcagggggctgagcagctccccaagtgctaacacctgaaaatcagcatagttggcccctcccccagaagacccgctagaccgacaggggaaaaacaaattattgaccaagcagcactagaaagttccagagaaagtcgagggatttacagtatacagactcagaggatactcccccttctttctttgttttttgatttctgtttgctcccccccttttttcttttttcttttcttcttttttatttatctttctttccttctttctttttttctttttcttttctcctttctcttctctctttatctccttttcccaatacaacttgttttaggccactctgcactgagcaaaatgactagaaggaaaacctcacatcaaaagaaagaatcagaaccacagagttacaaaatttggattacaattcaatgtcagaaagccaagtcagaagaactattataaagctactgatggctctagaaaaaagcataaaggactcaagagacttcatgactgcagaatttagatccaatcaggcagaaattaaaaatcaattgaatgaggtgcaatccaaactagaggtcttaacgatgagggttaacgagatacaagaacaagtgagtgacatagaagacaagttgatggcaaagagggaaactgagggaaaaaagagacaaacaattaaaatatcatgaggatagattaagggaaataagtgacagcctgaggaagaaaaatctatgtttaattggggttcctgagggcaccgaaagggacagagggccagaatacgtatttgaacaaatcctagctgagaactttcctattctgggaagggaaacaggcattcagatccaggaaatagagagatccccccctaaaatcaataaaaaccgttcaacaggtcaacatttaatagtgaagcttgcaacttccaaagataaagagaagatccttaaagcagcaagagacaagagatccctaacttatatggggagaaatatcaattaacagcagacctctccacagagacctggcaggccagaaagggctggcaggatatattcagggtcctaaatgagaagaacatgcagccaagaatactttatccagcaaggctttcattcagaatagaagaagagataaagagcttccaagacaggcaggaactgaaagaatatgtgaccaccaaaccagctctgcaagaaatttgaagggggactcttaaaattcctctttaagaagaagtccaatggaacaatccccagaaacagggactgaataggtatcatgatgacactaaactcatatctttcaatagtaactctgaacgtgaacgggcttaatgaccccatcaaaaggcgcagggtttcagactggataaaaaagcaggacccatctatttgctgtctacaagagactcattttagacagaaggacacctacagcctgaaaataaaaggttggagaaccatttaccattcaaatggtcctcaaaagaaagcaggggtagccatccttatatcagataaactaaagtttatcccgaagactgtagtgagagatgaagagggacactatatcatacttaaagaatctatccaacaagaggacttaacaatcctcaatataaatgccccgaatgtgggagttgccaaatatatcaatcaattaataaccaaagttaagacatacttcgataataatacacttatacttggtgacttcaatctagcgctttctacactcaataggtattctaaacacaacatcttcaaagaaacaagagctttaaatgatacactggaccagatggatttcacagatatctacagaactttacatccaaactcaactgaatatacattcttctcaagtgcacatggaactttctccagagtagaccacatactgggtcacaaatcaggtcttaactgataccaaaagattgggatcgtcccctgcatattctcagaccataatgccttgaaattagaactaaatcacaacaagaagtttggaaggacctcaaacacgtggaggtgaaggaccatcctgctaaaagatgaaagggtcaaccaggaaattaaggaagaattaaaaagattcatggaaactaatgagaatgaagatacaaccattcaaaatctttgggatacagcaaaagcagtcctgagggggaaatacatcgcaatacaagcatccatccaaaaactggaaagaactcaaataaaaaagctaaccttgcacctaaaggagctagagaaaaaacagcaaatagatcctacacccagaagaagaggagagttattaaaaattcgagcagaactcaacgaaatcaataccagaagaactgtggaacagatcaacaaaaccaggagttggttctttgaaagaactaataagatagataaaccattagccagccttattaaaaaaagagagagaagactcaaattaataaaatcatgaatgagaaaggagagatcactaccaacaccaaggaaatacaaacgattttattttattttttattttttacaaaaacatattatgaacacctatacgccaataaattaggcaatctagaagaaatggatgcatttctagaaaaccacaaactaccaaaactgtaaacaggaagaaatagaaaacccgaacaggccaagaaccagggaggaaattgaagcagtcatcaaaaacctcccaagacataagagtccagggccagatggcttcccaggggaaatctatcaaacgtttaaagaagaaaccatacctattctactaaaactgtttggaaagatagaaagagatggagtacttccaaacttgttctatgaggccagcatcaccttaattccaaaaccagacaaagaccccaccaaaaaggagaattatagaccaatattcctgatgaacatggatgcaaaaattctcaacaagatactagccaataggatacagcactacattaagaagattattcaccatgaccaagtaagatttatccccaggatgcaaggctggttcaacactcgtaaaacaatcaatgtgattcatcatatcagcaagagaaaaaacaagaaccatatgatcctctcaatagatacagagaaagcatttgacaaaatacagcatccattcctgatcaaaactcttcagagtgtagggatagacggaacattcctcaacatcttaaaagccatctacgaaaagcccacagcaaatatcattctcaatggggaagcactgggagcctttcccctaagatcaggaacaagacagggatgtccactctcaccactgctattccacatagtactggaagtcctagcctcagcaatcagacaacaaaaagacattaaaggcattcaaattggcaaagaagtcaaactctccctcttcaccgatgacatgatactctacatagaaaacccaaaagactccaccccacgattgctagaactcatacagcaatttgtcagtgtgtcaggatacaaaatcaatgcccagaagtcagtggcatttctatacattaacaatgagactgaagaaagagaaattaaggagtcagtcccatttacaattgcacccaaaagcgtaagatacctaggaataaacctaaccaaagagagaaaggatctataccttaaaaactacagaacacttctgaaagaaattgaggaagacacaaagagatggaaaaatattccatgctcatggattggcagaattaatattgtgaaaatgtcaatgttacccagggcaatttacacgtttaatgcaatccttattaaaataccatggactttcttcagagagttgaaacaaatcatcttaagatttatgtggaatcagaaaagacccggaatagctaggggaattttaaaaaagaaaaccatagctgggggcattacaatgccagatttcaggttaatactacaaagctgtggttatgaagacagtgtggtactggcacaacagacacatagatcaatggaacagaatagagtatccagaagtggaccctcaactttatggtgaactaatattcgacaaaggaggaaagactatccactggataaaagacagtctcttcaataaatggtgctgggaaaattggacatccacatgcagaagaatgaaactagaccactctcttgcaccatacacaaagataaactcaaaatggatgaaagatctaaatgtgagacaggattccatccacatcctagtggagaacccaggcaacaccctttttgaacagccacagtaacttcttgcaagatacatccatgaaggcaaaagaaacaaaagcaaaaatgaactattgggacttcatcaagataagaagcttttgcacagcaaaggatacagtcaacaaaactaaaagacaacccacagaattgggaagatatttgcaaatgacgtatcagataaaggtctagtttccaagatctataaagaacttattaaactcaacagcaaagaaacaaacaatccaatcatgaaatgggcaaaagacatgaacagcaatttcaccaaagaagacatacacatggccaacaaacacatgaggaaatgctctgcatcactgtccatcagggaaatacaaataaaaaccacaatgagataccacctcacaccagtgagaatggggggaaattaataaggcaggaaaccacaaatattggagaggatgtggagaaaggggaaccctcttacactgttggtgggattgtgaactggtacggccactctggaaaactgtgtggaggttcctcaaagagttaaaaatagacctcccctacgacccagcaattgcactgctggggatttaccctaaagatacagatgcagtgaaacgccgggacacctgcaccccgatgtttatagcagcaatgtgcacaatagccaaactgtggaaggagcctcggtgtccatcgaaagatgagtggataaagatgtggtttatgtatacaatggaatattactcagccattagaaatgacaaaagccaccattttctttgaagtggatggaactggagggtattatgctgagtgaaataagtcaatcatagaaggacaaacattatatggtctcattcatttggggaatataaaaagtagtgaaagggaataaaggggaaaggagaaaaataagtgggaaatatcagaaagggagacagaacatgaaagactcctaactctgggaaacgaactaggggtggtggaagcgacggggggtgaggggtgactgggtgacgggcactgaggtgggcacttgacggtatgagcactgggtgttattctatatgttggcaaattaaacaccaataaaaaataaatttttatatatttaaataataaaaaatgaaagaaagccagagtagtgatacttatatcggacaaactagactttaatccaaagactatagcaaggaatgaggaagtacactgtataatattaaagagaacaatccaacaagaagacctaacaattgtaaatattaatgccccaacctgggaggactttaacacccacttacagcaatgtacagattatcttaagtagaaaatcaacaagaaacaatagctttgagtgacacattagaccagagagacttaacagatatgttcagtactctccatcctaaaacagcagaatatacattcttttcaaaggcatgtgggacattcttctgaacagaacacatcctaggtcacaactcagccctcaacaagtacaaaaagattgagatcataccatgcatattttctgcacaatgctatgaaacttgaagtcaaccataagagaaaatttggaaagaccaaatattcacagaggttaaacaacatgctattaaataatgaatggatcaaccaggaaatcaaagaagacattaaaaatacatagaaacaaatgaaaatgagaacacaatcatccaaaacctttggggtgcagcaatatatataacaatacaatgtcctatcttaagaagcaagagaaagctcgaataaacaacctcaccttacacgtacaggattttatacctaaaggaaaaagaacaacacacgaagcctaaagcctaaagcagaagaaaggaattaataaagattagagcagaaataagtgatatagaaatgaaaaaaaaaaaaaaaaaaaaaccaaaccaaacaaaaaacagtagaacagatcaatgaaaccaggagctggttctttgggaaaaaattgtaaaattgataaactcctagccagacttatcgaaaaggaaaagaagggacccaattaaatacagtcacaaatgagagaggagaaataaccaacgccacagaaatataaacaattataggacagcattatgaaacactatatgccaacaaattgaacaacctggaagaaacaacttcctagaaacataaactaccaaaactgaaaaaggaataaatagaaaccttgagaacagacccattaccagcaaagaatcgaatcagcaatcaaaaacctcccaacaaaagaagtacagagccagatggctttccaggagaattctacaagacatttaaggagagttaaacctattcttctcaaacttttcaaaaaaaaaaatacaaatggaaggaacacttccaaattcattttatgaagtcggcataactctgataccaaaacaagagaaatattccactaaaaaagagacatatagggcaaagtccttaatgtacatggatacaaaaatttcccataaaatactaagaaaccaaatccaaaagtacattaaaaggatcattgtaaaatgatcagtgagatttattcctggactgcaagggcagctcactattcacaattcaaacaatgtgatacaccacattaatgaaagaaaggataagaaccacatgatcctctcaatagatgctgagaaagtatttgacaaaatacggcatccattcatttaaaaaaatcaacaaagtagagtcaacgagaatatacctcatcatcgtaaaggccatgtatgaaaaaaacactcctaatatcatactcagtggagaaaaattgaaagctttccctttatggtcaggaagaaaacggatatctactttcagaactgttatttaacagtactggaagtcttagccacaacaataagacatataaaggcatccaaatcagctaggaagaagtccagttctcactatttgcagatgacatgatactctatatagaaaacccaaaggactccaccaaaaaattgctagaattgatacgcaaattcagtaaaggcccaggatactaaatcaatgtacagaaatctattgcatttccttacatcagtaataaagcagcagaaagagaaaccaagaaatcaatcccatttataattgcaaccaaaataataaggtgcctaggaataaacctaactaaagagttgaaggaactttattctgaaaactataaaacactgatgaaagaagttgaagatgatataaattgaaagacattccatgctcatggattagaaaaccaaatactgttaaaatgtctgtactacccaaagcaattgacactattgcagtccctatcaaaatgccaacagcatttttcacagagctgaaccaaacaattctataatttgtgtggaaccacaaaagatcccaaatggctaaaacaacctttaaatacaaaacaaaactggaagtatcacaattagggaattcaaggtatattacaaagctgtagtaatcaagacagtatgatgctgctataaaaacagatatagataaatgaaacagaatagaaaatccagaaatgaacccacaattgtatggtcaattaatattggacaaagcaggaaagaataagcaacgggaaaaagacagtcctaacaaatgttaggaaaactggacagcaacatgcgaaagaatgaaactggaccagggcgcgatcctggggtcctgggatcgagtcccgatttgggctccctgcagggagcctgcttctccctcctcctgtctctctgcctctctctctctctctctatcataaataagtaaataaataaatcttaaaaaaaaaaagaaactggaccgctttcttacactgtacacaaaaacaaaatcagaatggattaaagacctaaatgtgagataggaaaccactaaaatcctagaggaaataggggcggactctctttgatattggtcataacaatttccaactagatatgtctcctgaagcaacagaaacaaaagtaaaaataaactattgggatttcatcaaaataaaatcttctgcacagtgaaggaaacagtctacaaaactaaaaggcaacctatggaatggaaggagatattgcaaatgacatatctgataaattgttagtattcaaaatgtataaagaatttatcagacttaacaattaaaatataaataatccaattttaaaaagggcagaagacaggaataaacatgcttccaaagaagcaaacagacatgaagagatgctcaacatcattcatcatcagagaaatacaaataaagctacaatgaaatatcacacacatcagttaaaatggctaaaactaacaacataagaaacaacaggtactggtgaggatacagaaaaagaggaaccctcttatgcagttagtaggaatacaaactggtaccggtacagccactctaggaaacagtatgaagcttcctcaaaacgttaaaaatagaataaccctataatccagcaattctactactaagtatttgcccaaagaatacgaaactactaattcaaagggatacacacactcctatgttcatagcagcattattaataatagccaaattatagaaagagcccaaatgtctatcaactgatgaatggagaaagaagatgtggtatatatacacattggaatataatgcagccataaaaaaggatgaaatcttgccatttgcaaagacatggatggagctagagagtattatgctaagtgaaacaagttggtcagagaaagacaaataccataggtttgcattcatatatggaacttaagaaacaaaatgaacaaaggaaagaaaggaaaataaaaaaatggattcaaccagagagaacaatcagaggattaccagtgtgggggtggctgggcagatgggcaaaattggggttggagggcagccccggtggtgcagcagtttagcgccgcctgcagcctagggtgtgatcctggagacccaggatcgagtcccacatctagctccctgcatggagcctacttctccctctgcctgtgtcgctgcctctctccctctctctctctctctctctgtctctgtctctgtctctctctctctctcataaataaataaataaaatcttttttaaaaattggggttggagattaagactacacttatcatgatgagtactgaaaaatgtatagaattgttgtattgcccacatgaaactatataatactatatgttaactatacctgagttaaaatttaaaataaaagaaatcatacagcaattcggcagtgtggcaggatgcaaaatcaatgcccagaatcagtggcatttctatacactaacaatgaacctgaacaaaaagaaattaaggagtcaatcccatttacaattgcatccaaaagcataagatacctagaaataaacctaatcaaagagggaaaggatctatagcctaaaaaccatagaacacttctgaaaaattgagaaagacacaaagagacggaaaaacattccatgctcatggattggaagaattaatatggtgaaaatgtcaatgctacccagggaaatttacacatttaatataatccctatcaaaataccatgggctttcttcagagagttgaaacaaatcatcttaagatttgtgtggaatcagagaagaccccaaatagccaggggaatattgaaaaagaaaaccagagctgggggcatcacaatgccagatttcaggttgtactacaaagctgtggtcatcaagacagcgtggtaatggcacaaaaacagacacatagatcaatggaacaaaatagagaacccagaaatgggtcctcaactctatggtcaactaatattcgacaaagcaggaaagactatcctatccactggaaaaaggacagtctcttcaatacatggtgctgggaaaattggacagccatgtacagaagaatgaaactggatcattctcttacaccatacacaaagataaattcaaaatggataaaagatctaaatgtgagataagaatccatcaaagtcctagaggataacacaggcaacaccctttttgaacttggccacagcaacttcttacaagatacatctatgaaggcaagggaaacaaaagctaaaatgaactattgggacttcagcaagataaaaagcttcttcacagcaaaagaaacagtgacacaaaactaaaagacaacctacagaatgggagaagatatttgcaaatgacgtatcagataaacgactagtatccaagatctataaagaacttattcaactcaacagcaaggaaacaaacaatccaataatgaaatgggcacaagacatgaacagcaatttcaccaaagaagacatacacatggccaacaagcacatgaggaaatgctctgcatcattggccatcagggaaatacaaatcaaaaccacagtgagataccacctcacactagtgaaaatggggaaaatacacaagacaggaaacaacaatgttggagaggatgtggagaaaggggaaccctcttacactgttggtgggattgtgaactggtacggccactctggaaaactgtgtggaggttcctcaaagagttaaaaatagatctgccctacgacccagcaattgcactcttggggatttaccccaaagattcagatgcaatgaaacgccaggacacctgcaccccgatgtttctagcagcaatctccacaatagccaaactgtggaaggagcctcagtgtccatcgaaagatgaatggataaagaagatgtggtttatgtacacaatggaatattactcagccattagaaatgacaaatacccaccatttgtttcaacctggatggaactggagggtatcatgctgagtgaggtaagtaaattggagaaagacaaacattatatggtctctttcatttggggaatataaaaaatagtaaaaggaaataaaggggaaaggagagaaaatgagtgggaaatatcagtgagggtgacagaatatgagagactcctaactctgggaaacgaacaaggggtagtggaaagggaggtgggcggggggttggggtgactgggtgatgggcactaaggagggcacttgacaggatgagcactgggtgttatgctatatgttggcatatcgaattccaataaaaatatatacaaaaaaaaccccacaaaatctagttttgaagaccacaataaaaaaaaatcggcagagaaactgaatagaactttttccaaagaaaacatacaaattgccagcaatacatgaaaagatattcatcataggtaatcatcagggaaatgaaaatcaaaagtacagtttaataccagctcacacctattagaatgattatcagaaagacaagagataagttctggtgaggatatggataaaagagaaccttgtgtattcttagaggaatttaaattggtatgggataggcactacagaaagcagtatggaggttccttgaaaaattaaaaattgaactactatatacttcagcaatcttacttctgggtgtatattcaaacaaaatgaaaactacatatcaaagtaatacctgcactcccacttcttttgcagattgttcacaatagctaagtcgtgaaaatattccaagtattccaatagatgaatggataaagaagatatatatttacaatggaattcaaccatgaataagaaggaatattaccattgaaagtaagtaattgaaagtaagaccaaatactcacaactaatagattattctaggacatccatacatttttctccaagatataagcctaataagactcaactctttttgttagcaaaagtgacatcaatggagccacagaatgtagtgacctccttaccacctaggaagatagtgctatcaggaatcagtaagttcaatatgttcacaggtgaggggaaccctgtcctctgagagtcccagctcagcagggccatcaagagaatatgcaggagacagggctgggattgttgtgagctggcaccccaaagagggactcagaatctttcctaaaattgttcaaatttcagtagatactgtagaaacacacaacaaaaaagagacacatgcacacagaaaagcaaagataaggtaagatgagagacaatgagagagatgcagacagtagagagagagatgcaaaaagaaacagagataaggggatctagataaataatggcaaaggtgcagatagaaatagaaagagacagaggcagagatgctatgaaagagtgagagacataacagagacagagatgcagagacagacacagaaaggtgcagagacacctctgtgttcattacagtgttattcacaataataagatatggaagcagcccaagtgtccattggtagatgaatggataaagaaggtatgacgtatagatactctacaataagagtattagatcttaccatatgcaacaacatggatggatctatagggtattacattaagtgaaataagtcacataaataaaagacaaatactatatgatttcacttatatgtggaatctaaagaacaagtttacatgaacatatacaaaaaaaaaaacaaaactgggatccctgggtggcgcagcggtttggcgcctgcctttggcctagggcgcgatcctggagacccgggatcgaatcccacatcgggctcccggtgcatggagcctgcttctccctatgcctgtgtctctgcctctctctctctctctctctgtgactatcataaagaaataaaaattaaaaaaaaaaaaaaacagaaacagattcagaaatacagagaacaaacttgtggttgcctcaggggacctcaggagatggatggggaaaataggcaaaataggtgaagaggattaagaggtacaaacttacacttattttttttttttttttttttttttttttttttttttccaaacttacccttataaaacaaataagttttggggacaaaaagataataaagtaaataatattgtaataaggggatagatgtgactgtccctattggggaaaaatttagtaacgtacagaattgtcaaatcactgtgctgtacaccagatactagcatagcattgtatgtcaactatctgagacaataaagaaaaacaataaaagatgtagagaaaaaactaaaggaaatataagggacaaggagagacacataaaaagaaaggtgcacacatggagatataatgaaaaaaagagagagatgaacatctcatcaaatgtctggatctagtaacatctgaaatcaacttgacctcagacttctttgtaacatgaacagagtaaacttgacttgggtatctatcatgtgaaaccaaaaatagtacttatattgctagttatactttttcaaaaataaaaatggaccttgatcagtgccaagacctatttgaaatgtcactgtggttttcagagacaccgcgggccactattacccacgccaggatacttccactgtaagcttatatacacaatactctgcaaacctgaagaaaggccagcacctccttaggccattgcactgaacaatactcaatatccagaaaggacgtgactattgaattgattttccatctccatctcccccgcctgctcttcatttggcacccccagatgcctctggtctcccttcaaggagcaatatgaccctttcattctgcactggtttcctgcctccacccagttaagaagactcagggtacagagaactcataatcacatttaattatgataaaatctctatcttcaggtaaatggcttcaatgtgcttctcttgcacaatctgtgaaggaagaatggaaacaggaaaatcccttggggcctgagtatatcctgtagcagggaacacacaggtcaatgcaggaagcagaatcacacccagatcctcaagagtcctcagagtcatgtaggactctgatctatgtgggggacagtctgtcaggcagctgggaattctgggcaggacagacggacactacaaaggatggaatctccggtatcctcaggcatcagtgcaggagccctgtagaaaagagagtgatcagcagaggagactctgacagatgagccctctcccctcctctcagggccactgcagcaccagagaaaactgagggccagggcaggcagtcatcacctcccccaatatttctgtaaaggtgaaaccaacttaagagaacatggcactccagctgcacacagatgtgtgggaggcagtgaagcagctcttgtcctttaaggggatataaaaacgtgtcaatctttttagtaaatataataactcaccatctttgcaccactagtggcctttcacatgtaaattcacacaggcagcagccaccaacacataacacaaagtgggcatcatcctggtgtctaacacccaagatgtggctctggttccgagtttcacagacagatagcaccaacgttatggcttgattccagggaacaactctggatctgcctacacaaactgggcaatcttcccccctaactcttgatctctgtagcagggaataggccatgaactgagaccattgtgcccaggtacactcacctcatgctcttccccctttcacccgtccctgcaaccccactgaatcagagcagaaatagtacctgccggtggagacccccgagatcctacaaaaggaagtgatacagaaaaaaaaaaggtctcataaatagccaccttctccctcaccccaaatggaggtgaaataagcaacttaattgaattttactttctccccactcatccactccaagaccttaactgccctaagctaaaatcccccaaaatcaatgacactgtcactagaaggaagggaagcagatgctctgaccctcttacagaaagaaactttcagaaaggagccagggagccaatgatgaactataaggaagccctagaatatgctccacctgttacctctgtggtagggctccttttcaaccaataaatcagattccagagtctccccctaggtggttccgtctctttccaccaccccagcctctttcctttcagagtcagaaggaaagagctaatctagagacagagccaacctcccccccccccccccgcnnnnnnnnnnnnnnnnnnnnnnnnnnnnnnnnnnnnnnnnnnnnnnnnnnnnnnnnnnnnnnnnnnnnnnnnnnngtctcaggcatagcccatctccctcatttccccagaatgccttacctttctggctcctgtgacggatgataaggccaagcccaaggaagatcagccccagcacgaagccaccaatgccactcagcatcttgctctgggcagattcagactgtggccctggggagcagagcctgagagtcagagttgtccccacaccccacaggctccctttgggaagcctgaagtccagtcaggtacaggacgtggaagtactgggtgaacctgaccacccctaggagagggaaggacccaccattagatccttgcacacagtgggtatgtggggggaaggagggaggctgaaacctgctcctccagacacatccataacctcaaacaccaaggtcccagtcaccagccagggcagtaaacccttcagagctacagggctgcgttgtggggccaaggtatggagaatgatctctctagtatctagaaagaccacgagatcaagattctcctgatgcccctgccgtgggacaagaggtactctaatctcctgtgatttccacctcagtagtgacatcaaggataacaaatagaatgggatgggctagaggaagctctgccctctgtctgtggggctcatcatgacaggaaacaaacttctccttacgccactgcactgtgatggggctctggaggctggcgtgctccacatggcaagtgtagacatctcctcgctggggagtcatctccagcatcacaaggatctggaaggtccagtccccattcctaataagtggagtggacacgacaccagctgtctgctcctggtcattccgaaaccaccggactttgatctggcctggatagaaatctgtcactgagcagaccagcagattgtggtggttcagaacctctgtcctggacggggagatggtcactgtcggttccactgaggggagtaacagacaagaaaagacaatgagatgtgagactacacagcaagtctccccatggagaaaagtcctcccttggtaccagcatggaaagatccctggattccaagtcttggatttggatctcagcttggccaccttattagtttgcatgaacacgtgagtcagtttacttctcagagtctgaagaaataatagcaatcattctaggaaagttattctgttgggatccctgggtggctcagcggtttagtgcctgccttcatcccaggggtgatcctggagacccgggattgagtcccacgtacagctccctgcatggagcctgcttctccctctgcctgtgtctctgcctctctgtgtgtgtctctcatgaataaataaataagatttttttaaaaaaaggaaagttattctgttgatattaattgatgcaataaagcatttttaaattacagatcgctgtattacacatgctactactacttatcacattttcaaaaataaaaataataaatttggacctctttccctcatccctactgatagataaagtggttgctaatccctaacatgcaaagtagttagttttgaaattaaatgacataatatagacagtgtgtggtaaggtatttgtctagaacaaggtattgattaaatggctacaattaactttcagaaagagtgtctacccctgaagtgagatgatgatgccctgaggaggtgatccaggaggaacaggatatgcagggcttaggccaaaagaaacctgagacaattcttattcaataataatagcatcagttaattgactccaaaacttcagctcttcctagtctaaaattagttgatattttctaagaaattaaaattctaggtccaagattgcagaggagatggagaccttggtttcatctggtcccaagagttcagctacataggtattaaactattctgaacacctggcaactcaaccagagacctagaaaagattagctgcaactgcaactccactaatagaaaagcaaccactttctgcaaggtaggaggtgcagagaagtgaatccaaggtgataacatgggaagataaactgggcgggcagggggttgtttaagcagccagctatcagaaagtgatatagcagtgaagtgcaaaatcagaacttttagaagtctgccccagtgagggatgtccttgcctgaaaaggtgctcaagcagcaaagtaagggtagaatcctaggtagtacagtatggtctcaggatcatggggtcagaggaagaccgagggtgcctgaatgtggcagagttccgaggtatcagtgtggggaaatcaactgcaacagtgatccaaggagaggttccacgtctccaaccatgtctcagctccagagttgccataaacctggaacaacagcacagtcagcacaactgctctctaaggaggggctcagcaagtagcagaaccagtgagaacctccttcctcccctaggaagaatggcctgtggtttacaccacaggagtctgaaaggtttagggactgaaaatactgtctcatacctgagacagaaatgctgggtcataggctgggtgagcacagagtgtggacagggactagagagacaggagtgcttgactgctttttcctgatgatgcactgagagtggggtcccaagctttctgctctaggctagagattgagaagctgccattttcattttcatcttctaaagctgcccagaaagccttcaggaaacaaaagccacctagaccaatccagagcagattagtagattagtagataaacagattataatgatgattttaaagatactagcagggcttggaaaaaagcatagaagacactagagaatccttcctggagaaataaaagaactaaaaatctaatcaagtcaaaataaaaaaaggctattaatgagatacaattgaaaaatagaggctctactggctaggaccaatgaggcagaagagacaattagtgatacagaagataaagatggagaataaagaagctgagaaagagagataaacaactactggatcatgaggggagaatttgagagatatgtgataccataaagtgaaacaatattagaataattgggatcccagaagaagaggaaagagagaatgtgggggagtgggttgtgggcagaaggtatattggaataaattatagctttgaaattctttaatgtggagaaggaaccaggcattcaaacccaagaggcacagagaacccaccacaagatcaataaaaattgtcaacaactatacatataccagtgaaacttgcaaatctcagagacaaagaaaaactcctgagcgctattcagggcaagaggtccataaactacaagggtagaaacattagactgatagaagacctatccacagagacctgggaggccagaaaggactggcgtggtatattcagggtgctaaatgagaaaaatatacaggcaagaatactttattcagcaaggctgtcattcggaatggaagaagagacaaaggttcaggacaaacagaaactaaaagaatttgtgatcactaaaccaaccctacaataaatactagaggggatcctttgagcaaagagagagcccaaaaataacatagtctagaaaggaacagacagtgactttgcagggaatacaatggcactaaattcacatatttcaatagttactctgaatataaatagctaaatgcccccagtcaaaagacaaagggtattgattggataaacaagcaagatccagtgatatactatctgcaagagactcattttagacccaaagacacctccagattgagggggtagagtaccatttaacatgctgatggacatcaaaagaaagctagggtggcaatagtcatgtcagattttaaaccaaaactgtaataagagatgaggaaggacactatatcataattaaagggtctacccaatagggtctaacaattgtaaataggtatgcccctaacatgggagcagccagttatataagccaattaataacaaaattaaggaaacatgttgataatcatacaataggggatccctgggtggcgcagcggtttggcgcctgcctttggcccagggcgcgatcctggagacccgggatcgagtcccacatcgggctcccggtgcatggagcctgcttctccctctgcctgtgtctctgcctctctctctctcactgtgtgcctatcataaataaatttaaaaaaaaaaattaaaaaaaaaaagataatcatacaatagtagtaagagactttaacaccccactcactgcagtggacagataatctaagcagaagataaaccaggaagcaagggctttgaatgacatcctgggccagatggggacttcacagatatattaagaacttttcaccctaaaggaacagaatacaaattattctcgagtgcacgtggaatattctccagaatagatcatgtactgggtcacaaatcaagtctcaactgaaaaatagcaaaaggttgggatgatttcctgcatattttctgaacacaatgctttgaaactggaactcaatcacaagaggaaatttagaaagaactcaaatacatggaggctaaagagcatcctactaaagaatgaataggtcaaccaggaaattaaagaacttttaaaaattcgtgcaatttaatgaacaaatgcagagctggaatagagttaaggagcaaggaagaatggtcaaaaggggacctggaaggtacattagtccctccaaccctcacctcaggtccctcagaataaatagagaactctctctcctcccttctctcttgtcctaaggggaaattctctccactccattgtggtgctgtgtggtagaggccatgtcagacctggggattccccagtctcttacaggcctcttcacacaggcttttcaatgagcaacaaaagtgtcagcttagaatgctttttctgattcgctaaaacctcatctgaaaggctctagctcaggcttctgtcagctgcttcccccctgagacagtcaacattctctacattttctagagctctctgtgctacacatagcttatcccattactcagggtagccactgctggcctggcctgagaggaaggcaactcagacacccgattcaggggcttacctgaggtaccctgctgggcccctgtggatgtgggcacttaggatgaaggcaatgtgtatcccatgtgggtagacaagcaatcaagaagtattcatgaaataggtagggttataataaagagactcaccctagaggacatactctgttgcctcaggaaggaaaataaaagctatagactctttctttgtgggcattcatcattcctggtcagcatctcttggaatctgtgcttggtcagtggagataattgtgatattaataataataatcaccttgtgaccagaatgaccatccaggactgcttgcatgttcaattaattaattaattaattaattaatcaatcaatctttcaatataaattggaataaatagtttaattaaataatattctttggctgaatttgataaattttatgaattaatcctttagagaaattagcaaaaaccctttaaaatgctaaaattcataaaataagatacaactctgaaaggatttgacaccaagataaatataaactgaaatgtttctatctaagtgtcaaaatgctgacactttcttatgtttactagacaagtaatgaataaatttggtaaaactcttcctcgaggaatgttttgttagattgttaaatgtactaaacctagtcgagatgtcattcaacaaactgatgcttgggctactggctgttaattagccattagttcagtaaattgatcttttggcaaagaagcccctgaacctgtcaggcatatccttgagagtgaacacaaaacttcaaccacaaattgcttttatccagttcttgtttctggacaagatttcccaaatttaagaccctccaacagtaaaccaaatgtttaaagaaaaattaacatcaattttatatgatctcttccataaaattgaagaagaagcaggaacttctgggtagctcagccagttaagcatgagactcttagttttggctcaggtcatgatctcagagtcctgggataaagtcaggctccatgctcagtgggaagtctgccttttctccccttgtccctctggccctccccatgctcttgctctctctcttaaataaataaataaatcttgagcaaaaaaagaagaggaagaaacacttcccagttcatgttatgaagcctgtattaccaaagccaagcaaaaaaaggataacacagacaaaatacaaagcagtatcttttatgaacataaacataagaaatgcctaacaaaatgttagcaaatagaatttaataatctataaaaagactaatattcattgactaggtgatttattccagcatggttcaacattcacctatcagtcaatgtgactctccatattgcatgctaaagaccaaaaattacatgattatatcaattgataaagaaaaagcatttcacaaaattcaacatgcagtcatgagaaatgcttttagaaaactagaatacagggaaatctgtaacatgataaagagctacaaaatatcctaacatcatacttaatggtgaaaaattgaatgctttccccctaatatatccaggctccagaagaagtcaagagatttatagtatatagaactaggggggcccctttttcctctttttccagtaaaacttgtttttatatcagactaaaaatttccaatattttttctcttttcccaccttaactacaatattttaccactgcttcaatttaaacatcatcctttttgactgccatatttctacaattacatgtcttagatatattttccacttctagattcccttcaatatactcaatttaatttttggagatacatgagatagttttttttgttttgtgggtttttttcctctgccacatttttttctacaatggtggaagttaataccttctaaaaatgaccagcatgcgcccagaaccaagtggaatacggtgctggttcatgctgtgagattatattctctcttcattcccactctgctcccctcttttatctcatttatgttttggtggtcaatgttggggctttctacaagtattgctggtttatataaatgtgggactgagcatcttctaacacacagaacttaataaactcagaaccaagaggctcaccccctagaacccctcaggtagactatattctccctcgacttcaatttcttcaccaccaccatctcccagtccacccctctttttcttcttcttcttctttttttttctttttttcctttttccttttgctttttttctcttcttttttcttctttcttctttctcttctttggactttgtggccttatattttttactactttgttttaaaatttgtttttcactttagtggtccttttattttcttttgttctgatctttgctttcattttctggtctctgacctcatgagaataatctagggtgaaatttacttaggtcatggttgatattcttgactgagcccactcatatagccactctgaactgagcaaaatgactagagggaagaagtcaccacaaaagaaagaatcagaaacagtactctctgccacagcgttacacaatatggattacaattcaatgtcagaaagccatttcagaagcacaattataaagctactggtggctctggaaaaaatcataaacgaatctagagacttcattactgcaagttttagatctaatcaggctgaaattaaaatcaattaaatgagatacaatccaaactggaggtcctaacaacaagggttaatgaggtggcagaaagagtgagagacatagaagacaagttgatggcaaggaaggaagctgaggaaaaaagagaaaacaattaagagaccctgaggaaaggttaaaggaaataaatgatagcctcagaaggaagaatttatgtataactgggttccagaaaatgctgagagggaccgagggccagaaattatatttcaacaaatcgtagctgagaatttccctaatgtgaggaggaaaataggcattaagatccaggagatagagcagtcactccaaaaaatcaataaaaaccgttcaacacctcgacatttaatagtgaaacttgcaaattccaaagataaagaaaaactccttaaagcaatgagggacaagagattcttaacttatatgtggataaatatcagattaacagcagcagacctctccatagagatctgggaggccagaatgggctggcaggatatattcagggtcctaaatgaaaataacatacacccaagaatactttatccagcaaggctctcattcagaataggagagataaagagcctccaagataggcagaaactgaaagaatatgtgaccaccaaaccagttctgcaataaatattaagggggaccttgtaaaagaaagaggaagcccaaagaaataatccataaaaacagggactgagtaagtattatgatgacactaaattcatatctttgaatagttactccgaatgtgaatgggctaagtgatcccatcaaaagacacagggtttcagactggataaaaaagcaagacccgtatatttgctgtctacaagagactcattttagacttaaggacacctccagcctgaaaatgaaaggttgaggaaccatttaccattcaaatggtcctcaaaagaaaacgggtggcaatcctcatatcagataaattaaagtttattccaaaaactgtattaagggatgaaggagggacactatatcatacttacagggtttatccaacaagaagacctaaaaatcatgaatatttatgcccctaatgtgggagctgctagatatatcaatcaattaataaccaaagtaaagacatacttagacaatacactaatagtaggagacttcaacatggcagtttctgcaaattacagatctttttttttttttttttttttttttaattacagatcttttaagcacaacatcaccaaagaaacaaggactttaagtgatacattggaccagatggatttcacagatatttacagaactttacatccaaatgcaactgaatacacattcttctcaagtgcacatggaactttctccagaatagaccacatactgggtcacaaatcaggtcttaactgataccaaaatattgagattgtcccctgcatagtttcataccacaatgctttgaaactagaattcagtcacaagaagaaatctggaagaaactcaaacacttggaggttaaagaacatcccactgaaagatgaatgggtcaaccaagaaattagagaagaattaaaaagattcatggaaactaatgaaaatgaagatagaactgttcaaaatctttgggatacagcaaaagcagtcctgagaaggaaatacatcacaatataagcatccctcaaaaaattggaaagaacttaaatatgcagggtaatcttgcacctaaaggaactgaagaaaaaaacagcaaataaaacctacaccaagcagaagaagagagttaataaagattctagcagaactcaatgaaatagagaccagaaggagtgtacaaccgatcaacaaaaccaggagttgtttctttgaaagaatcaaaagatagataaaccattagccagccttattaaaaagaaaagactcaaattaataaaataatgaatgaaagaggagagatcacaatcaataccaaggaaatacaaatgattttaaaaacgtattatgagcagctatatggcaataattaggcaatctagaagaaattgatgcatttctggaaaaccacaaattaccaaaactggaacaggaagaaatagaaaacctgaacaggccaataaccagggaggaaattgaagcagtcatcaaagacctcccaacacacaaaagtccagggccagatggcttcccaggggaattctatcaaacattaaagaaataatacttattctactaaagctgttccaaaggatagaaagggatgaagtacttccaaactcattttatgaggccagcatcaccttaattctaaaaccagaccagggttccctgggtggcgcatcggtttggtgtctgcctttggcccagggcgcgatcctggagaccgggatcgagtcccacgttgggctcccggtgcatggagcctgcttctccctctgcctgtgtctatgcctctgtctctttctctctctctctctctctctctctctctctgtgactatcataaataaataaaaattaagaaaaaatattaaaaaaaataaataaataaaaccagaccaaaaccccaccaaaaaggagaattatagaccaatgtccctgataaacacagatgcaaaaattctcaaaagatactagccaataggatccaacagtacaataagaagattattctggcagccccggtggcacaccccagtggcacagcagtttagcactacctgcagcccacggtgtaatcctggagacccgggattgagtcccacgtcgggctccctgcatggagcctgcttctccctctgcctgtgtctctgcccctctctaaataaataaataaataaataaataaataaataaatatttaaaaaaaaaaaaaagagtattcaccatgaccaagtgggatttatccccgggatgcaaggttggttgaagactcgtaaaacaatcaacgtgatagatcatatcaactagagaaaaaacaagaaccatatgatcctctcaatagatgcagagaaagcagttgacaagatacagcatccattcctgatcaacactcttcaaagtgtagggacagagggaacattcctcagcatcttaaaagccatctacgaaaagcccacagcaaatatcattctcaatgaagaaacactgggagcctttcccctaagatcaggaacacgacagagatgtccactctcaccactgctattcaacatagtactagaagtcctagcctcagcaatcaggcaacaaaaataaataaaaggcattaaatttggcaaagaagaagtccaactctccttttcacagatgacatgatactgtacatagaaaatcccaaaagctctacctcaagattgctagaaatcatacagaaattcagcaatgtggctgaattggatacaaatcagtggtatttcttgagagcttgtttgaaggttctagcaggggagcgcagctactcgtatacccttgaccgaagaacggtcctcctctatcggggatggtcgtcctcttcgaccgagcgcgcagcttcgggagggacgcacatggagcggtgagggaggaaggggacacccgcctagccagccagatcagccgaatcaaccctggcgatcaatggggtgacagatgtcgcagccagatcgccctcacatcccaaatcagtggtatttctatacactaacaatgagtctgaagaaagagaaattaaggagtcaatcccatttacacttgcatccaaaagcataagatacctaggaataaacctaaccaaagaggtaaaggatctataccctaaaaactacagaacacttctgaaagaaattgagaaagacacaaagaaatggaaaaatattccatgttcatggactggaagaattaatatggtgaaaatgccaatgctatccagggcaatttacacatttaatgcaatccctatcaaaataccatggacttcattcagagagttggaacaaatcatcttaagatttgtgcagaatcaggaaagaccctgtatagccaggggaattttgaaaaagaaaaccagagccgggggcatcacaatgccagatttcaggttgtactaccaagctgtgatcatcaagacagtgtggtactggcacaaaaacagacacatagatcaatggaacagaatagagaacccagaaatgggacctcaactctatggtcaactaatatttgacaaagcaggaaagactatccattggaagaaagacagtctcttcaataaatggtgctgagaaaattggacagccacgtgcagaagaattaaactggaccattctcttacaccagacacaaagataaactcaaaatggatgaaagatttaaatatgagacaagaatccatcaaagtcctagagaagaacacaggcaatgccctttttgaacttggccacagcaacttcttgcaagatacctccatgaaggcaagggaaacaaaagaaaaaatgaactattgggactccatcaagataaaaagcttctgcacagcaaaggaaacagtcaacaaaactaaaaggcaacctacagaatgggagaagatatttgcaaatgacgtatcagataaaggactagtatccaagatccataaagaacttattaaactcaacagcaaagaaacaatccaatcacgaaatgagcaaaagacatgagcaccaatttcacagaagaagacatagacatggccaacaagcacatgagaaaatgctccgcatcacttgccatcagggaaatacaaatcaaaaccacaatgagataccacctcataccagtgagaatggggaaaattaacaaggcaggaaacaacaaatgttggagaggatgtggagaaaggggaaccctcttgcagtgttggtgggaatgtgaacgtacagtcactatggaaaactcctcaaagagttaaaaatagagctacgttgggacccagcaattgtactgctggggatttaccccaaagatacagatgcagtgaaacactgagacacctgcaccccaatatttatagcagcattgtccacaatagccaaactgtggaaggaacctcggtgtccactgacagatgatgtataagaagatgtggtctatatatacaatggggtattactcagccattggaaacgacgaatacccaccatttgcttcaatgtggttggaactggagggtattatgctgagtgaagtaagtcaatcggaggacaatcattatatggtttcactcatacaaggactataaaaaatagtgaaaaggattataggggaaaggagagaaaatgagtgggaaaaatcagagagggcaacaaaacatgagagactcctaaccctgggaaatgaaccaggagttatggaaggggagttgggtggtgggatgatgggcactgagggggtcatgatgggatgagcactgggctcatgagcactgcggcaacaggctcagagtccaggatcctgaggggagggggttgaggaaataaaagtaaagagatggggacaggagggacacagtggatgatgttcaagcagtgtcagctttattcaaggttctacaacattatatagcataagcaaagcaaagataaggaagtgtccattcttagcatatttgtgaatccctccaagctttccctttatcagcatgcaagacagacccacaggggccagaagatttagggtcctggttaatagataagcttgttgctctaggtgtatacacctcgaaggaacattatatatggttaacagaccagcaaggacagcacagacccttatttaagtttatggccaggccagaataaattgtatctattgtgttatgtgggtgatcacgtaaaagcgaactctgaaaaccattgctcaagccctttctcaagcgtcaatcaactattcaccctttaggctcccgagccttttgagtgaatgagggacgcaagtctgggcctggtttggtttgttactccagctagtccgtggccacccgcatgggtgttatagtatatgttggcaaattgaaatccaatttaaaaatctacataaaaaaataaataaaattaaaatttttccatcttattgttccaacgtctatgtcatatctgagtctggtcttgataatttcttttttcttttttcttttcttcttcttcttttttttttttttttttttttgtcctgataatttctttgtctcttctgactgtattttgtttcttgccttttgatatgcctcataattttttcttaaaaagccatacatgttttataagcagaaggtacttggataattttcttatacctgaagatggcatgcttttccttctgctaggcatttattatgataatttttgctaatttaatcattaattgaaatggatttgatgtttgtcattactggtcaccctcaacacattggagctttcaaattcctctgatgatacctggtatttgtcccttcatctagctttgtgtcttccctgcaggcctcttcctcaagagaatctgtttcttgaaattctgccagctatattccacttttagtgattattttcaatcaacatatcctaatatggtggtgaaatatgggatagggtctttctctgatgttataattaagtcttaggcaagtgctgtcgacttagatctcatcacagtagccttcacaagtgtctttgcccttctcatgaatagggcttctttcctcattcccctcccagatgcaggctcatgatatataccccatcagcaagatgaagccagtccaggattatgattgaatattgttggctgaaggacactgccctctaaggcaagaggtaagacttgcaccaatgatgtgaaccaagatggcatgattcctcacactactaaacctacttgtggactttatgctatctctagaaacttgaactctctcaatttagacatcctggttcctagaagaaaaacatttctgaaaaataacaccataagatgaaatttgactatgatagtcatcacatgccaaagaattaacaagcaaacaaggaaatttatgtattgaatagagaagctgatcttaattgccatgggaaactaggattgctcatacatagtaagggcagggaagaatatgtttggaatctatggaatttactggataatcttttattattttatgcatggcaataactatcaatagacactaaaacaatcatgatccaacaaaggtggaatatataagagcatagagactcctgaaataatatttgctataaccaaaagattactggaaaagcaatctagaccaaatttagagggtgtggggagacttgacaatgacttatgaaggagaaagatgatgaatattagttacaatcacaaggccagctacaacagtggacactagcaaattccattgcaatataaagcattgcaaccatcatgctttagtcttctaggagatcacacttgatcaacttcttgaacctcttgcggaaaaatttaggaaaaaatttcacagaaaactatactgaagttgagaagcctgggtccctgaattagcacctggaggagagttacccactagtcatcaacacctgctcttgttacactagtgagatatgaacttctactgtatttgagccattatacatctttgggtctatacatctttgggttacagcagtttggcctttcctaactaatatatgaagaaaataagtgtgagtacttatcatttttacctataaaatgagaagagctcaataaagatgatagtaaacccttatacattggtgatgagctgtaaattgataaaacttttgtggagggaagtttggcattatcaaccagaattacaaatctacaatctttgagctagcaattccacctctaacaatttatcttcatattcttatacatttataaagtcatgtgtgtataaagttatttgttccaccattgttaaaagataatgaaaacaatctaaatgtctattactatcagactgctaagtggctattttcaaaatgagacagatattaatgttctgatatgaaaataatagttgcaaaaagtaaagtacatgccatatgaagatgtatgctgataatggagacctgtaccaatgatagatggagatagatgacttttgcttttacatgtttagaatatttctggaaggataaacattaaatactagcagtgcttacctcctcagaggcacacatagtggctgtatgtttggtttgggagagataaactttctactgtaatgcacctatgcagcaaacttttctcgtgaacgtgtattagctattcaaaataaattgaatttataaacaagccaaaaataatggggaaaatttaaattagaatatttaatttcccatggaccagtctcacatgaaatgatcctcattttttaccttagaattatcataagctgtaaaacaggattttgtgaaaacattcaagttgatgatgatgctaaattagcagctagggtatgtgtctagactttagaccatatcaatcctccctgtacacccttcaccccattcttcaaagcattctttcatgttcagaacatgggcctatctttctttgacatattacctcctgattttatattgatcaaatcaattgtgattattttgaaagcatcttatagaaagactatcttgttgaatgtcatgttcaattctgggtactctgtcctatgcctcgtactgatattacttcaaaaaagagattttatttatttattcacgagacacagagagaaaggcagagacacaggcagagggagaagcaggctccaagcagggagcctgatgtgcgactacatcctgggactcaatcccgggactccaggatcatgccctgggcagaaggcccaactgctcagccacccagtgatccccaataactttcaaactatcctgatcacctatgaattcaacctgagatataaagaaataaagctggaactctacaaatggaaaagtgaccactttttgcaaggtaggagtgtgaagaagagaaacaaggggatatatcagaaggtaaacagtacaaggagggagcctttttaagcccactgcaggaaagtgatacatctctggaactcaaattcaggacctttagaaatctgctcctgagagagccttctctgcctgaaaagtgttaagtggtgaaccagggcagaatcataggagggacagtgaattctcaatattcctggaggcatagaaagcacaaggacacctaagctggcaaagctcccaagctttggagcggagtatcggctataggtcagtgagcctgatagagggctcctcttgtgccataacccacaaactgtggtctgatcaggagacctctgtcagtgatgggtcctagcaaaggactggaatgtagcaaccttccactattcatcaggaagaggcagaacaagtatgtactcaacaagatgaacactctccttgccagggccctgcaacaatcagaattggggcgaccatcctctccctccaggaggggatgagttgatgggcacacaagcaggcaaaacctctcctgccaccctgcaccctttaaattccacaaatcagtgtccccctgcctgccgcaaaggaagatctgagcaagtgggcactataggaatctgcagtttggcacacactcttgccccagggctgagatctggccacagccaattttttttcctttcaccctcaagagtggcctggcctccagggagcagagacttcacagggcaaatgcttacactgagccccaccacctagcaaagggtggggcatcttcaaccaggcacagacacctaagaatcagcacagcaggcccctcctccagaagacctgctgaaagaacaagaggagcagcaagcttactgaccaaacagcactggaaaaatccaggactgagtgaaaatggtaaatagaacttgagggtttttttcttatgattcatttatctttcaggttaaaattttccaaaattctttcttttctcctgtctttaatgttttattaagtcttcattttaaatttttttcttttttgactttcatattttacaattacatgttatagatatattcttcatttttggcttgctttcaccgtattcaattttatttttatgtatataaattttgttggtttgtggttcttttgtttggttgtttttttttttttaataattttggaatttagtaccttctaacatacaaaccaaaatatattcagaaccaagtggatcaccatcttggtccactctgtgagaatatattctctctcccccaccatttttgaaaatttgtttttcttttttgttgcctttgttcttttattttctggccactgacctctttggaattgtctagtatgtattttgctttggttgtggttgctatttttgactctgctcactcatacagccaatctgcactggacaaaatgactagaaggaagaattcaccacaaaagacaaaccagaggtaatattctctgccacagatctaatggatatggatttaagtaaaatgtcagatatagaattcaggatcataaatataaatttgctagtggacttgaacaaagcataaaagactctagagaatctcttactgcagaaatgaaatctaactgagatgcagtctaaactggatactctaacagctagggtaaatgaggaagagtgagtgacatagaagataagatgatggaaaggaagaaaactgaggaaaagagagaaaacaatcaagagcctataaaagactctgataattaagtgataatttgaaaataataacatctgtatttttggtattctagagggcatggagagggagagaggaccagaaggtatgtttgaacaaatcaaagctgagaacttccctaattctgagggaggaaacaggcatttataaccaggggatagagaggacccctccccaaatcaacaaaactggtcaacaccctgacatataatagtgaaacttgcaaatttcagagataaagagaaaatcctaaaagcagctcaagacaagaaattcctaacatatagggagagaaatatcagattaacagtagacttctccacagagacctggcaggcctgaaagggctggcataatatattcagggtatgaaatgagaaaaacatgcagccaagaatactttatccagcaaggttgttgttcagaatagaagaagtgataaagagcttccagaacagatagaaactgatagaatgtgtgactaccaaaccaaccctgcaagaaatattaagggggatcctgtaagtgaagcaggaacccaaagaaacagagacaatcttcagaaacagggactgtataggtagttcaatgacactaaatccatgtatttcaatagttactctgaacatgaatgggctaaatgatccagtccaaagatgcagggtatcagactggataaaaaaataagacccatctgtatgctgtctacaagagactcatgttagacctaaggacaccttcagactgaaaatgaggggcagggaactgtttataatgcaaaaggacttcataagaatgctggggtagcagtcctcatatcaattcattaggttttatagaaagtctgtactaagagatgaagagggacactatatcatatttgaagggtctaatcaacaagaagacctaacaaatatgaatatttatgtctctaatgtgaaagaagccatcctatgaaccaattaataaccaaagtaaagagacacataggtaataatacattaataataggggacttcaacaccccacccttagccaaggacaaaccttctaagcagaagattaccaaagaaacaaggactttgaatcacacactagaccaaatgcatatttttatatcacaatgctttgaaactagaacttgatcacaagagtaaatttggaaggaactcaaacacttggaggttaaagagtatcctactaaaagatgaatgtatcaaccagaaaattagagaagaattaaaaatattcatacaaactaacaaaaatgaaagcacaactgttcaaaatctttgggatacagcaaaggcagtcctaagaaggaagtacatttcaaaacaagcctctctcaaaaaattggaaaaatcttgaatacgctaaccttacatctaaaggaactggagaaagaacacacataaagcctaaaccaagcaggaaaagagagataataaagattagagcagaactcaatgaaatagagaccagaagaacagtagaacaggtcaactgataaactaggagctatttttttgaaattaataagacaaataaatccctagccagatttattaaaaagaaaaaagaaaggattcaaactaataacatcatgaatgaaagggaagagatcacaatcaacaccaaggaaatacaaacgattttaagaacatattaaaggggagcctgagtgagtcagtggttgagcatctgtttttggctctgggcatgatcccaaggtcctggaatcgagtcctgcatcaagctccctgcagggagcctgcttcttcctctgcctgtgtgtctgcctctgtgtgtgtgtgtaatgaataaataaataaaatctttttttaaaaaaagaacatatgagcaactatatgccaacaaagtaggcactctggaagaaatggatgcattcctgaaaaactataaactaccaaaactgaaaaaggaagaaatagaaaactgaacagaccaataaccagcaaagaaattgaagcagtcatcaaaaacctcccaagaaacaaaagcccaggaccagatggctttccaggggaattctaccaaacatttaaagaagaactaatacctattctactaaatctctttcaaattacagaaatggatagaaaacttccaaacttgttctatgaggccagcattaccttgatcccaaaaccagacaaagaccccaccaaaagcgagaattgcagaccaatatccttgatgacatggatgccaaaattctcaccaagatcttagccaataggatctaacagtacattaagaggattatttaccatgacaaagtggatttatccctaggatgcaagaatggttcaacgttcataaataaatcaatgtaaagatcacattaataatagaaagtacaagaatcatatgaccctctcaattgatgcagagaaagcatttgacaaaatacagcatcttatcctaactaaaactcttcaaagtgtagggacaaagggaacatatctcaatatcataaaagccatctatgaaaaacccacagtgaatatcattctcaatgcagaaaaactgagagctttcagtcaagaacatgactgggatgcctgctctcaccactgtcgttcaacatagtactagaagtcctagcctcagagatcagacaacaaaaagaaataaaaggcattaaaattgacaaagaagtcaaactctcactcttcacagatgacatgctatagatagagaacccaaaagattccatcccaaaattgcttgaacacagacaacaattcggcaatgtggcagaatacaagaatcaatgcacagaaatcagtagcatttctataaactaacaatgagactgaagaaagagaaattagggaatctattccttacaattacacccaaaacaataggatatctaggaacaaacctaaccaaagaggtaaaagatctatactctaaaaaatacagaacatttatgaaagagaggaaaatgtaaagagatcgaaaaatattccatgctcaggaattggaagaataaatattgtgaaaatgcctatgctacccaggacaatttacacatttggtgcaaaccctatcaaaatacaatgtacttaaaaaaaaaaataccatgtactttcttcacagagttggaacaaataatcctaagatttgtatggaaccagaaaagaccctgaatagccagaagaatgttgaaaaagaaaaccagggattccttggtggctcagctgttgaatgtctgcctttggctcagggggtgatcccagagttcccgagattgagtcacacatcgagatccctgtggggagcctgcttctccctctgcctgtgtctctccctttctctctatgtctctctctttttttattattggagtttgatttgccaacatataaaatgacacccagtgctcatcccatcaagtgcccccctcagtgcctgtcacccagtcatcctatccccccgcccacctccccttccactatcccttgttcgtttcccagagttaggagtctctcatgttctgtcactctctctgatttttcccactcattttctctcttttcccctataatccctttcactattttttatattccttgtatgagtgaaaccatacaatgtttgtcattctccaattgacttacttcattgagcataataccctccagttccatccatgttgaaacaaatggtgagtattcattgtttctaatggctgagtaatattccactatatatatagaccacatcttctttatccattcatcttttgatggacactgaggctctttccacagtttggctattgtggacattgctgctataaacattggggtgcaagtgtctcggttgttctctctctctgtgtctcttatgaatacataaattaaatattttttttaaaaaaggaagaaaaccaaagctgggggcatcacaatgccagacttcaagctgtactacaaaactctgatcaccaagatgtagtatggtactggcacaaaaacaggcacataaatcaatggaacagaatagagaacccagaaatgggccctcaacgctatggccaattaactaatctttgacaaaacaggaaagaatatccaatggaaaaaagacaatctcttcaacaaatggtgttgggaaaactggacagcctcatgcagaagaatgaaattggccattctctttcaccatacacaaagataaactcaaaatgattgaaagatctatatgtgggacaggaatctgtcaaaatcctagaggagaacacaagacaacaatttttttgacctcagacacagcaacttcttgcaagactcgtctccaaaggcaagggaaacaaaataaaaaatgaactattgggacttcaagataaaaagcttttgcacagcaaagcaaacagtcaacagaactaaaagacaacctacagtatgggagaagatagtcacaaattacatatcaaataaaggactagtatccaaaatctataaagaagttatcaaactcaatacccaagaaacaaacaatccagtcatgaaatgggcagaagacatgaacagtcatttctccaaagaagacatacacatgaccaatacatgaaaaaatgctccacatcacttgccatcagggaaatacaaatccaaaccacaatgagatatctctttgcactggagagaatggctaaaattaacaagacaggaaacaataaatgttgggagaggatgtggagaaaggggaaaccttcttgtactttcagtgggaatgcaagctggtgcagccactttggaaaacagtacagaagttcctcaagaagttaaaaatagagctaccctatgacccagcaattgaactactgggtatttacccccgaagatacagaagtagtcaaatgatgagacacctgcaccccaatgttcatagtggcaatgcacacaatagccaaactgtggaaagggcaatgatgtccttcaacagatgaatagataaaaaaaaagatgtggtatacttttacaatggaatattactcagccatcagataggatgattacacaccatttgcttcaatgtggatggaactggatggtattatgctgagtgaagtaagtcagtcagagaaggacaatcatcatatggcttcactcatatgtgggatataagaaatagtgaaagggattataagggaaaggaggggaactgagtgggaaaaattagagagggaggcaaaccacgagagattcctaactctgggaaatgaacaaagggttatggaaggggaggtgggcagggggttggagtaactgggtgacaggccctgaggagggcacttgatgggatgagagctggatgttatactatacattggcaaatcaaatttcaataaaaacaaatgaaaaataaataaataaataaattgaatgcccctagcaagtgactctatatctttcattatagttccagaaattttatgatcctaggcctgttttacatcaatgttttactttggtttttttatagaagtaggaagtcaagttttatagtttcatttttatcagcaagacaggtattttcatttacattaatgaataaggaaaatgaaaccaaaaagacatgtcagaacttcacttgcttgtcaatgatgtgagcaactcttctggtcagtcagataatagttttctaatattggaagggtattttctcctatttttgtgctattcacaatggtttcaccacaaatgtgatatccgtctaagtttaatctaatccatcactttcttaagtctaaaccaagctctacaaactgcaggcaataggcctgccacctatctttgtaaataacactttattggaacatagccatgctcattaatttatatattgtcagtggcagccctagcaccacaatagcagaatcgaggagttgtgacagaaactgtatggcccacaagcctgaaatattttctatctggccttgaaaaaaatattgccaatctctgatttaaacaatcaaccaaacaggaagtcaagtcttgctgatttccatagtataaatattctcaccatagctgatttcaagttaccaacatgatgtcactgaaccaagagttcgaaagagatgctcgtagaacacccttgtatagcattttcaacatatacctacaacagttgtaaataatctcaaaagcatatacaatagtaacatgtattaaaataactaggaagtgagaattttttaatgtttcttttgcttttaatattatttacaaggttatatgatttaatttttaatcatggctgtgtttaacaactgacttgcaaaattcatgaaaaaatttgctcttgcaagcttctatgagctggctccagtgcaacactgctgatatgcataaaacaattctagcatctttggtgtggagtgtcatcttccaatatctgcaaaaaatattaagtttcagcttccactcaactgaagctggaatttccctctttgtttattgatatctgtagaatatttttcttgaatttttagctcttttttggtatattttattgtgataatcccccagtagtttcatatccttagtgtaggtagaagtacttcccaagagacctcatgttgcaacactgacaggtagcctcatttcttacattctaccacccattccctatgctgaaaattaatgttttaccctttgtcctagagcttcatttgctgacactacagatagaaattatgagggtttcctgacctggcccaatgaccaatgtcagacattaagatttcatgctactatcaagagacaaccactgaggttttagcacagaaccagagggacattctgggaagaagatagcaggttgaagttgagtttaaatgtgtatcaatcaggtccctggctggaataagatgggaaactcagattggttaatttgaggatctatttacaaagctatgatcatcagagtgtaggcaaaccatagagacagagaggtatcctgagctagggacagcaggagcaaactttcctcaagccctaagggatgaaggaacagtgacaaaggagccctggaggcagagagtactgtgtagagagccacctgataacatgtgtgaccttctagttaagtgaaacggccagcctcctgtggtctgctcagagttggaggggtgggttggtgaggtcagcccattttcctctcttcttccaatcctctgattatgctcctcattactcaacgcaatcaaggagataggaggtaattccatgtggatcagctgctagaagcacagagcaaggcagagaaggggggagaataaataaggaggataaattaaaagaactgtggtgaggagagaaccatggaacctgggagaaagagccacagattggaggtaatgcaaactcaaatcagtcatttgaatgttttctcctattttcaaaaggtcaggaaaaaaaagtgatttaggaaagaagcttgtcctacagtggctggatttcaggactatttatattaaaatgaaactcattgctgtttgtatagagacaaatgcctcccaatctttatctctctctctctcccctgcatgcacacataaggtgtaaagattttgaataataattcttcattcatgactcattctcatttgtctaagcttatttttatctgattttttattttcaataacataataagctgtggtgaatccaacacccagcacatgtatgagaaccttgacaataactttataataaatatatctaagtccattaggccattcttattgtgttatttaaatctatatcctatctcaattctctatgaggaattatgagccatatattaaatatcctagtacaatggtttggtttgtcatcttctacctgtatgttgtattttttattcttatcttggaggctattgtattagatgcacatatgcttatagttgctatgtttttcttgatacagtgaatgtttatcatcccatgagtccttctttcctacaatgcttttttactgaaaccttttcttgaagtaagctctatgcccaacatggggcttgaactcactcccatcaccttaagagttgcacgttctaccaactgagccagccagctgccctttccttaaaatttattttttgactgtaatatatccataaccgattttatttacttagtacttgcataatagatgtttttcattttttgcactcaatctctgaaatagcctttatgtttttaatcatagtctcataaataatatcacccaaatttatgtttttgtgatcaatctgtcaatctcttttaatcacaggtttagtccatttgcacttactgaaattaatgagatatccagaccttttataccacctcatgtttctcatttcattttctgcatgattttaatggcttgttttcactattcactcatgtctggaatccatgctagcatgtgtagcaagtcccaggctactgtctggggggtggttcttttttggtctctgccctgagacatgttttcagaatctgtttaagtttacatcgctcatttctagctttttgcttcatgtaggaattattattctatacccagccttttacagatattaagattctgtcctgctttcattatagcttgtctctgggccctaaaccccttgtttgcatgaagactgcatgtccttagataccacatattaatagagattctctgattgcttttattttcttttaagaaaacttctaaaaaagcaattatcaatgtccttgaaacattaacttgaaaaaaaaaaaaagaaacattaacttgatgtgttgttttcaaattaagtaatctactgaaaactatatgggctttccaaaatatacctccctgataatcctgtttgaggaaagtaaactaggttatgggagaggacttagctcttgcaggaggaaaggaactgtctgacattggaaaaagttgaaagacaaaatttgtggtgaaaagaaaggatgatggtaaatagcctttgcagaagctcattaatgattcgggagagcttggttcttgtctcatgcaaagaatgaatctcacagacaacgaacggagagtgagtaaagtgatagaagtttattaagcaaagataacagagaaagctctcagaagtgagaggggtcccaacagggttgccactgagggcttgtagaggcagtcttttattgagaactgactgggaagcttgtggccttgagattcttgtgctgtcttgatttgagtaaggaccagtgataacatctttaatggcttacttctttggggtctggttattctttgttggtcacagataactgtcataaaaagacaccctccctgcccacacctagggcagggtggtctggcttgctcccttacttatctctgatttccttatacttcagcattttgtggatttttgtggtcctgcttctgtgaccccctacctagcagtaactagccctgtttgtccctaactcattaataccacgaatacatttttctccaaccagtgaagagcataaggggaggcagcatcacttgtctctgtcagtccaagctactaataaccacaaataattataaagtagcagtagagggaggcagagagaaggtggagtgaatttccattcaaattaggaacagaggggtgcctggctgtcttggtcagttaagcctctgccttcagctcagatcatgatcccagggtcctggaattgacccccatgttgggctccctgctcagtgaggagtctgcttctccctctcctcctcagctcatgctctctctctctgtctctctcaaatgaatacataaaatcttttttaaaaaagcaaaataggaacagatatataacattgcaaggcattaatttgacaaagaaatataaaaattaaaatttttaattacaaaaatttacccagaagcctaaaaccaagagtaattgaagacatataccatatacacaaatgggaatatggtgttggatttaatgtattttcaaacgaaaggctggttcaacacccgtaaaacaatcaatgtgattcatcatatcagcaagagaaaaaccaagaaccatatgatcctctcattggatgcagagaaagcatttgacaaaatacagcatccattcctgatcaaaactcttcagagtgtagggatagagggaacattcctcgacatcttaaaagccatctatgaaaagcccacagcaaatatcattctcaatggggaagcactgggagcctttcccctaagatcaggaacaagacagggatgtccactctcaccactgctgttcaacatagtactggaagtcctagcctcagcaatcagacaacaaaaagacattaaaggcattcaaattggcaaagaagaagtcaaactctccctcttcgcggatgacatgatactctacatagaaaacccaaaagtctccaccccaagattgctagaactcatacagcaattcggtagcgtagcaggatacaaaacaaatgcccagaagtcagtggcatttctatacactaacaatgagactgaagaaagagaaattaaggagtcaatcccatttacaattgcacccaaaagcataagatacctaggaataaacctaaccaaagatgtaaaggatctataccctaaaaactatagaacacttctgaaagaaattgaggaagacacaaagagatggaaaaatattccatgctcatggattggcagaattaatattgtgaaaatgtcaatgttacccagggcaatatacacgtttaatgcaatccctatcaaaataccatggactttcttcagagagttagaacaaattattttaagatttgtgtggaatcagaaaagaccccgaatagccaggggaattttaaaaaagaaaaccatatctgggggcatcacaatgccagatttcaggttgtactacaaagctgtggtcatcaagacagtgtggtactggcacaaaaacagacacatagatcagtggaacagaatagagaatccagaagtggaccctgaactttatgggcaactaatattcgataaaggaggaaagactatccattggaagaaagacagtctcttcaataaatggtgctgggaaaattggacatccacatgcagaagaatgaaactagaccactctctttcaccatacacaaagataaactcaaaatggatgaaagatctaaatgtgagacaagattccatcaaaatcctagagaagaacacaggcaacaccctttttgaactcggccatagtaacttcttgcaagatacatccacgaaggcaaaagaaacaaaagcaaaaatgaactattgggacttcatcaagataagaagcttttgcacagcaaaggatacagtcaacaaaactcaaagacaacctacagaatgggagaagatatttgcaaatgacatatcagataaagggctagtttccaagatctataaagaacttatcaaactcaacaccaaagaaacaaacaatccaatcatgaaatgggcaaaagacatgaacagaaatctcacagaggaagacatagacatggccaacatgcacatgagaaaatgctctgcatcacttgccatcagggaaatacaaatcaaaaccacaatgagataccacctcacaccagtgagaatggggaaaattaacaaggcaggaaacaacaaatgttggagaggatgcggagaaaagggaaccctcatacactgttggtgggaatgtgaactggtgcagccactctggaaaactgtgtggaggttcctcaaacagttaaaaatatacctgccctacgacccagcaattgcactgttggggatttaccccaaagatacaaatgcaatgaaacgccgggacacctgcaccccgatgtttatagcagcaatggccacgatagccaaactgtggagcctcggtgtccaacgaaagatgaatggataaagaagatgcggtttatgtatacaatggaatattactcagctattagaaatgacaaatacccaccatttgcttcaacgtggatggaactggagggtattatgctgagtgaagtaagccagtcggagaaggacaaacattatatgttctcattcatttgaggaatataaataatagtgaaagggaatataagggaagggggaagaaatgtgtgggaaatatcagaaagggagacagaacgtaaagactgctaactctgggaaacgaactaggggtggtagaaggggaggagggcggggggtgggaatgaatgggtgacgggcactgggggttattctgtatgttagtaaattgaacaccaataaaaaataaattaaaaaaaatgtattttcaaacgaaacccatatgagaatgagaatacaaacagtagattggataaagtactaaatttagtgaaattgatagctatactctggtacatataaaaaagtcattttttaaggaaataaacagtgcagtgtttaaaggtaaagggccatatgtatacattttcaaaaaaatattgtgtatatatatatatatatatatatatatatacagtacatatttactattcttattctttcagtttttctgttttacatttttacaataaaacagaaaaaaattgggatccctgtgggcgcagcggtttggcgcctgcctttggcccagggcgcgatcctggagacccgggatcgagtcccacgtcgggctcccggtgcatggagcctgcttctccctctgcctgtgtctcagcctctctcctctctctgtgtgactatcataaataaataaaaattaaaaaaaaattatataaaacagaaaaaaattgcaaggttataaaatattacccctgtaaaataaaaataaaattctatgaaaagaggacagagaactgaaagattctaaaagtcattaaaaatgatgaatgggcaaaactaaccaagtacagagacccttgggtggatcagttagttaagcattggactcttgatttcagctctgatcatgattttgggctacacactgagcaaggagccaggattctctctctccctctctgtctgcccctccccccagctcacacctctcccttaaaagaaaaaatactaaccaagtacagcaattcctcttcttactcattactgcaactttactttttcattatctctcttctctatacactgttatattttcttttttttttacactgttatattttctaaaaaacaatctcattctctgattgcttcttttttcacagcatttcaaatctccctaagaataataattatttatttaagttgtttttcttgcctgcctcacctctaagatcttttttcccttttttttcattgatcttttctttatcatgttggatttcccaaaaatatcttctctgcattggttattagttcacattttgaaatgaggcacataaatgtggcttaagagactgtggcagtaagaggcttatgaaaagatgggctttgggcttacatggctgacaattcactggaaatatcataatgtgaaatttctctttttaggtgactcatatccaaaaagcaaacttacagtgtcttagttgggggaggcggagcaagtgtacggtaaataaatggctgcccatgttccattgcaagggaaggccaggggttcaataaagatgctaaaagtgctttcaattaattcccaaaatgtacaaaattttaaaagactaaataaatgaattatggtgcaaatatatacagtccttcaaaacaatgttttagaatgacacttcgtgacaaagaaaaattgtttatcatatgttaaatttaaaagtagttaaaattagcctattcaatatgatctcaagcctctaaatatctttctatttataactatatctacatttattgtcttcaaagcctagaaggaaaaaaattatcacttgaggatctgaaatacaataaaggtgatcttgttttctcctcttcctacttcaaatatcgactgacaaatctgttctgtttggctttaaaaacacagcaattaaatgaaatctgtgtgtggagctattagtcacaataatatacagaactcttaaagttgagtaaccaactattctgtccctttgttcatctccaccaggcttgtggtaccacttaccatcaaggcaacacaattacactttttaatttcatttgaactgctaaacccacttctcaatctttttatttattcattcattcatttttattttattttaattccagtatagttaacatacagtgttatattagtttcaagtttacaatatagtgattcagcaattctatacattagtcagtgctcatcacagtaaatgtgtttactcttaatcctctcatctgtttgacccatcccccacccacctgccctctggcaaccattagtttgccaactaatctttagttaagagtctgttttaggtttgtctcttttttcctttggtttttttcttagattccacatatgaatgaaataatatgatatttgtctttctctgattgacttatttcatctagcattatgctctctagttctatctatgttgttgcaaaggcaagatttcattctttttatggctgagtaatatatctcattgtataaatatataccacatcttctttatccattcatatagcaatgagcacttgtgctgcttccataatttatctattgtaaataatgctgcaataggcacaagagcgcatgtatcttttcaaattattgttttcatacctcggtctttttacatgttctttgccatcaacctttctagtttctctcaaatataatttaatactttaaaaattcatttaaaaaattaaaacaaatggaaggttgctgaaagggaggtggggggatgaagtaactgaatgacaggaacacacatgatgtgatgagcactgggtgttatactatatgtcggcaaattgaatttaaattttaaattttcttaataaatgttaaaacaataaacttatatcatatttcacttaaaaagtgagaaaaacagagacaatgaaaactctcacactttccacatgatctaaatcttgaacccataaagactagggtattcagaagttgcgatgggaacactgatgaggatagggcactctcttccatgggagaagacagttgtcagaagtatccacctcatgctgatgcacatacaagcccttcctctctcagctggaaatgacaacagttaattgtcttgctttgagaagacaagttttactagccacaaaggatgacagttcataaaatatgtacataagataaagataatttcaggtttctagcctatgcagattctgtacagtaaacattcacatagtcaagcctatgtgtgactgtttatttataaggtatttatttttatttactaggcatctacttaatagattccaggcattataataataagtactgagaatacagagatgtctacctagaccttgcccattagtgatcggcagaaaagaacttagcaacagtgcaaatttccacctcctggatgggggtgaaatgaaggaagatctaggcagacccatattaatttatctcttttgaataatggaagtggtgatcataaagactggcccaagagctataaaaggcagtgtcgcatgatggctaagcatgtccctctggaaccagaccgcctgtgtttgagttgtggcattcccatttactaatgttgcatcagcacacaagtgaactccccttcaccagtttcctcatctgtaactgtgaacgatgattatcatgtctcctcaaaagactgttgtaaggactcggtgagccaatattcataaagtatataaaaaggtattaggcatacaggaagccctcaataataaaaatagaataatagagacaaaaagaataatagcagtcactttgtactagagttctaccattccctagggtccctgagaaaataaattagcccccaaacaatctgggagacatctgtactcactgcccctaaccccagtcctatttccttctaatctactagtacaccatggaacctttgtcgacctagaaactgtaagaaacagctattcatcaatgggtctgaagtcatcactcattttcattgattagaccagggacatagctgggttttaaatgatttcatttgactctgatgttcatttgaccccttgtgcaagaactttgtcctggatttcccaaccggaaaacacattaagctcctgatatttatattcatttatttcttgcaaaatttactagtaccaggccacccctagtttgagatccatgacctgcttggtgacttcaagatctgaaatggtatctgtcccctcatcttactgctgatcctatcatctccctttgaaattagggcaatcatgtagaagaagcagggcaggaaagatacacattaacacaaaggcggttcctacaactactcccttccccaaaactctaaaacttaaagctaacattcaactctaacacctaagtaaagaccattgatagcaaagagactttatgggagctattttcaaaaataatggtttcctctccaaccaatgagagaagtaggtgtggggcaatatcatttgtctctggcagtcgaattactaagaaaatcaacaagaagcacagagctgcaattatggggaaacagctcataaaataaacatcaaaaatgtgtagaatcattagaaattatagacatctttgaggtcatatagtaaaaaagttactgaaaagaggttccatattctacgatttatagtacaatccaaatccactgagcttgaaagagttgactacatgaaattaaagaattatcaacaagtgtagatggacagaaataaccactatacttattttttctgtcaccacactaatcttttcattttgtaatgaactttataataaatactttacttttttctctgattattccttttatcatagaacattgtcttgttatgtaggtgtggaggccgagaaaaattaagaacattgcctttgtcaacaagggcccaggacccatgattgggtcctgcaaaggatccttggaaaaagtgagggaatgtgggacccaggaaatctaacaaaaatcccctacccctggacaagcagagcaggactaactccattctgtgctacacccgccatctcatataaaaccccccacagacctgcctattgtttaaggcactccctcaccctagtttagctattaagcacacccttatcagaaaccagcacacttaggaatgccttacctctgacctttaaccagccaaggaattaaaatccctcttttgcccgccaaacctgcgcgccaattctaaccagaataataggctagttcaaatggtcactatagggtgaatcgaaattcaattggccacctgcgtgtggaccaacatgaccgcgcaactttctgcgtatgttacaatctcattggccactggcccctataacactgctgtgtttcttagtctcgcggtccaagcccctgctctgctgtatggagtatacttggacccaagcacgagcttgtaaataaaccctcatgtacttgcatcggtgttggctccttggtggtttctcggattcgcaatcttgggcacaacagaggcaactgttacgtaaatgctactgaatatacagtttgggaatataacagagctattttttagcaccaagattagggcaatgatggcataaaggccattcaaattcagtggaatgtactagcccacaaacttgacctctctgatacacagagaaccttagaagccacaacaatgatgataaaaagttcttttgcagatgggaggtggcatcacatgcctctggaagattcaatctcaaagaaggcaaataagaaaaatatatttgtagaaacaggagagatgttgtttaagggtacaaacttgcaactagcagataaatatgtcctgaagatataatgcacagtaccgtgaatatagaaaataatattggattataatcaccaaacatgaaaaaaattgcagaatttttctagttttaatagaaatgaaaaagtaaaatattaaaagatgaaattaaatatatggagagaatcatgaaaaaattagaaaattcagtgaagttccatagaaaatataaataaatggaacaatatatcctgttcctagataggtttctagattatctctctgtctttatagctttaattatattgacatacaaccaactgctcgtatttaaagtgaataattccggatcatttgggtgattcagtcagagaatattccctcttggtttcagcttgggtcatgatctccaggtcctgggaaagagcctcacctcacatcaggctctgaactcagagaagggtctgtctgagaaatctctgtccctctctcactgcccctccccgtgctctctctctctcaaataaataaatcttaaggccatcactcaccatttggtataaagatgatcattctccctattgaattgcctaggcacctttgtcaaaagttaattgtatatacatacagaactatttctggaatctctattctgttccatttgcctaaatatctatctttacactcataccacactgtatggacatagctatctaaaaacatcttaggggtgcctaggtggctcagtcagttaagcgtctgcctttggatcaagtcactatctcagggtcctgggatccagccccacattgggctccctgctcagtaggggttctgcttctccctctttctctgcccgtccccctcctcatgttttctctctctctaatggataaataaaatcttttttattttttatttaaattcaattaattaacatataatatattgttagtttcagaggtaagggtgagttaattcatcagtcttatataatactcagtgctcattacatcacgggccctccttaatgtccatcacccaaaatccttttttagaatatcttataactaggtagtataaaccctccaactttattctttttcaaaattgcttttgctattctatgtcctttgcatttccatgtaaatttaagaataagctgcttaatttcttcaataaagtctctatggatctgaactgcaattgtgtcgaagttacacatgaagtagaaaagaatttatatataaacaatgctggggatccctggatggctcagcagtttagctcctgccttcaactcagggcatgatcctggggtcccaggatcgagtcccatgtcgggctccctgcatggagcctacttctccctctgcctgtgtctctgcctctctctctctctctctatatatatatatacatatatgcctctctctatatatatacacacatatatgtctctcatgaataaataaaatctttaaataaataaaaataaacaatgctgattcttacagttcttgagcatggtatgtgtctccatttgcttaggtatttaatttctctcagcagtggtttataattttcagtatgcaggttgtactcatctactgtcatttattcctgagtgtttatatttttgatgctattataaataaatattataagtttcaaatttttattgttcattgcaaatgtatggaaataaaattgatcacctttattggatgtgtatcctgcaatctgccagaatttttccttatactgaatttcttttatagagtctgtagatgttctatcataggaattgaatttaaacaagaagttgaaaagaaataaaaaataaataacaagaagttgaaataaatagaaacaaatgagcaaaggttaaagaaaaacaaaagagagatgcaaacctagaaactgaccttcaaatatagagaacaaacaccaggtgctcaacacataagtgcactccttaatcagtttgttgtatggacgtgttgaactggaaagttgaattcctatattgagcaaatgaaactaatattatactatatgataactgtataaaagtaaaatcttttaaaaaagaagaaattaacaaactatggccagtaaacaaatccaggcaactactattttttgtattatctatgggctacaatgtgtgtgctaaagatgacttttacctttttaagtggttatagtttggatgattgagtatcaacataatatccttgattttatctcttagaccacaaactctacaatattcaccatctggccctttacagaaaaagttagtcaattcctatttatagagtcaatcatgttacctgtaatataattttactctgttttttccaattggtatgacccttattccttttcttgatttttgcactagatagaaacttcaatattgactagaaatggtgagagcagaaattttgctttggttgcaatcttagggggaaagcatttattctttcaccagtaagtttcatgctagcaataggtttttcttagatgggcttgatcagattgagaaaatctcctgttattagtagcttactaaaaatttctatcatgaataggtgttggattttgtcgaatatactttttgcattaaatgaatggatttttttgtcgtttttgtctgataatatggtgaattgcattggttgatttttgaatgctatctaggttatactattttcttgagtgacttttggtagttgtatttttcaaggagttttcccatgtcatctaagtggtccaatttttaaggataaagcttttgatatattatttttattataattttaattttttataatctatagtgatggcctttctctcattcttgatatttgtaaattgtgtttctctctttccattctgatcagtctccctaaaggtttatcaagtttactgaccttcccaaagaattgtatttttgctccattgattttctctattatttttctgatttccatgccattgatttctactctgatctttatgatccttttgtctgcttaatttgtgcttcagtttatatccaattttccagttttttaaggtagaattgtagtctattgattttagatttttcctcatttctaatataagcatttaatcctgtaattgtccactgtattaaaattatttaggtgcattgcataaattgtgatttattatgttttatttcattcatctcaaaatactttcttaatcttcttctgatttctcctctgacctatggtttatttagaagtgtgttttttgctttacaaatatttggtaatacatttttgtatttatttctaacttaatttcattttggtcgatgaacaaaccttgaatcattttaattcttaggaattcactgatccttagattctccctacaaaaaaaaaaaaaacatttggcataattcaaagttcattcatttacaaaatcacccaataaaatagaaatgtgtgtgtgtgtgtgttctcctgaagaaaaagggagacaagaagggctcctgttttattaaaatacattgctattgtttaattttaaaatgtactcttctgataatttttaaatataaatttaaaataaaagatcactctttataaagcatcaggaatgaatgcattagattacgcagaagataatgaaagctcaatgtgaaaaagaatagcatcttgccctggagaggtttctttttttaaagcatgcaattttatggtagtgatctcttacctgttagaacgtaacgtgtaaaagactgagctcctcagtcttcaggcaaaagcaagctttaagttccgctccatttcatgcttccttgtttctcaaatatccaaaaccacatctcaggttgcatcatattttggaaacatagaaggaatgatcagggaaataagtgctggctaggcagccaccctcttggaaagaatgcatgggctttccgggtccaaatctatgcagctgagagggagaagggaaagccacagcttgccttggatttcttaaagtgcagagtctccacctgctggtatatgtgacccaaataatatacttctggctatcactcttctaggatggtttagagggatcttgaatttccagtacaatcaatatgcttcagcatctttttacatcaaaagaaaaacaagagggcacctgggtggctcagtggctgagcgtctgccttcggctcaggtcgtgattccggggtcctgggatcgagtcccgcatcgggctccccgcggggagcctgcttctccctctgcctctctctgtgtgtctctcatgaataaataaaaatatttttaaaaaagaaaaacaagatataaacctcaacatttttgaaatgttatttagttctctgagggtatggcaatgagagtttcaaatcatgccacagaaggcaaattttaaagtaacacccttaatagcaatccctttccccaatatccattcctcttagcttctgctcagattttcttctctctcctttgtgtctcttccatctccctatcccaaaccagctctcttacactgccttttctgcagcacccagcttcctgcataacctccttttctcttaattgctttctgccttctgatatttcaggtaagaaatttgcttcctgcctggttcctcttcttttatgtataaactatctgttagttagcttatttatttcttttctaaaagctatgagatcaatctttaatcatcattgtttttctttcacttctgatcttgtaatcaaacaatttcatctctacatatgtaactgtgtattttcattattcctgcttgatgcctttaagttgcacgaatcttacccattcaagactttacctcaggaaaaggttttctattatttctttaattatattctcgtctatatctattacacagcgattggaggttgttgtactgaacttccttaacatattttctcaattttgtgtgactcaaggtagctgggactcaggggtccagttttgtcttgttctctctctcccacccatctatatcttatgaccattacctgagcagtctaactacttagtccttttgcatctgccttaaagaatgctccctcattaacttcaagactgaaagcagtttaaaatgagaccatttgaatgttatcttattctttcttctctcctttaaggattccgatatacatatttcctttttcttgcctgtcctctgtatcaattgttgtatcactgtggcagatacactttggaaagatcaaatggctaaagaattcagtcccacaaagggccctctcagagcttctaagtgtgccttactactgcactcaaggtgttgtccctcaaaatgctcagcaggggtcaacgcagagaggtgattgacttgcaaagatcagtagatatgacttttgtctatggagtgaatttccataaaatccacaaagacatacaagttttgaaaaagtactgctgtgtggagtaaagggagaaagtacaaactgaaaagaggttatgaggctcccctaatgccactggcaggaagcagtctgatgaagctactcactcacaaacaggtgccaccgtccataaaaaaagaaggatgactcagaggacagaaccaagaatccagagagaaaaacaaagagccacagaggatcagtcagggaaataagcactgacagactgccactttctgggaaggaatgctggccttttccagtccacatctgtgaaagtgagaaaattgattattctcagtccttgaaatgtgatcaaggaattctgactagggttttcccaacaggaagtaagaattgtcatggattagtgacacctttttaacttccactttccctctcttcgaacaagaatacttatagcagctatcctacacctgcctcaccattgtaagatgggtgtagtggaggcagataacttgtctctagtttcacaggtccacgaatgaagaggaattgtaccctgggagttgtacctaatggattacagccaggggcctcatgttcatctggacctgatttagatgagatttggggatttgagctggtactataatgaaagaagatttgttattctgcatgtgggaggacattggaccattagagtcatactctaaggtgaccttcttgtacaacctcctcccttgaaagttaaaaggaattaggacttgcttctaaccagtacagtatggcaaaggtgaaggatgtcatgtctaaagacaaagttaaaattaggttatgttatatggcaaatgtgaaaggttggcattcccttgatttggatgttaccaggcaaaggtaatgggagatcaatttgtgattgtgttttgttgtattagacttcattttagcatgctggagaaagagattcctctttactggctttgaagtaaactccatgttatcagaggcccgcaagaaggaatatggtaatgaactgcatgcaggtgatctttctgaatggagagtggtccctaaccaacagccagcagtagattaattctgccaaaaacctaaataaacttgaaagtagatttttccccagtcaagcctccagttaggaacacagtctctgagaccctgagcaggggagcaggttagttgtgactagacttctggccacagaaactataagggaaaactttgtgtcattgtaaactgctgtttgtggtaatctatttgcagtagaaaaacattatcatcactgatacctgtttatctatcttatttcattatcattctctggactctatgccattttgcaatgtcctttgttgtgtttcaatttgaatatattatccatttgtaatttagtttttatttctaacatgatttcatctttttaaattattatttcctctcctgagttaactctcatttcatgatttcatgtttcccttccatttaattcctgggtctctagtttctactgtgaattttttttcaactcacgaatgcctggttcagcttgtggcatagcactacagttgtcttctgcttcactggtggtgatgatattctcgttctggttgtcattcttgttttagagaaaatatgcattatctgacagaagctttagtggagcatatgtgcagctacatgttcactctgtattgtctattttcctggaccaggaaaaacagttgtgtgtacgtgggataagaattctttttttttttggggggggggataagaattcttatggctttctaggtttcttaattcaagatcaccctgtgctgttagcacagtgaagtacattttcattaataccaggaatctttgggaaagagaggggttgacaggtctgactttgtgagtctcttttgttcctgaaagtaacttaattttccctacttgcttctttttttacctttactaccatgagtcttgggagcctccaagatttaaatcaccactttattccctataataacatcttcccaagactatcccccctttgactctcttcacattaaagtccttttctgtaggttccacagtatgtatactgtatctatatgctatgtcccagatttgttttcaaaatttccctgctcagaagaaaatgttatttttgcaataataactttctctctgtccattcccctaatccccactccacttttttttcttccagtcattctaaccattcttacatagtccccaaacttgactttgatagatatgagtatttatttccctgcttttattaagtcaaagtttatagtattttctgtgttctggttacagtgtaactatgggttacacatgattttcttgtctgccttagaacataaattatgagtacaattggatgattgttaacaaactgaacacactgcttggaccaatagtcacatcaagaaatggaatatttacctcaaactcagaattccccctcgtgcttcctttcagtgatttcttcctcaagggtagcgctatcctgattttttagcagtatggattatttttgcctgttttgaactttatgtgaatgaaatcaagtgctataactcacttatctctgagttctttcactaaaaagtatgtgagattcattcacgttattagttcatttattcttataaatagctattgtatttatattcttaaatttatgtgttttactcttgaaatttattttgatagtctccagtttgtatttatcacaactagttccattattatcattcttttagatgttttgtagtgagcatgcaaatacaattcttttcggtgtgtgcctagtattggcatcactaggttttaggttaggtatatgttcagctttagtagattttgcaaaagggaatttttaaagtatgcatactgatttatatatactcaccagtaatgtgtaacaattctaatcatttcacatatgtgccaaaacttaacatttctctttttattttccttatagaaattttggtaaacatagagagagatatcacattgtgaatttaaatattgttaaccaatgattactgtggatgagtctctgtttatatgtttattggccatttgaatattctgttttgtaaagtaaactttaagttatttaaacattttcccatcatgttttctgcctttttgagatggattcctaggaattccttatgtattctggatatgaaccctcttgttgaatatatgcattgcaaatatttttgctcaaaagagagatcagtttgtcattcatcttctggttgtttggggtttaatttgctctcttgctttcctaatttccaaaggtggaagtctatcttattgatgtgagatttgttcttttctgatagtgatgtttgcagctataaaactctctttaagcattgcttttgctgcacctgtttggtatgttgtgtttttgttttcatcagctttaatttcccttgtgatttttttctttgacccatgcattattttaaagtatgctgtctagttaccaaatattaagaaagtttctaattttgttctgttgttgatttttaacttaattccacatactttgtatgatttaaacccatttgtaaattatgaagactttttttatggcttagcatatgatccactctgaagaatattccatgtgcacttgagaaaaaaatgtgttctgctattactgagtggagttctctatagatatccattagatcaagtcaattgatagcattgttcaaattgtctatatccttgctaattttctgactatgtgttctataaattttgaaatttatctcagtaaagatactgagatctttaactattaatgctgaattgtctatttctccctccaattcggtcagattttgcttcatgtatttggggactatgttgttaattatatctatgttaataatttgtatatctccctgagaaatgacccttttatcattgtgaagagtctctcttcatctctagtaatatttgtaacaaagtctatttttggcttatgttaatgtagccactcagcttttcacgattattgtttgtatgaacatctttttccaatcatttactttcaaactatgtgtatctttggatctaaaatgtgtttcttaaaaaaaaaaaataaataaataaaataaaatgtgtttcttataaataccatatggttggatctttttttaatcagtctgacaatatctgccttttggttaaaatatttaatttatttaaatttaatgtaactacttaaatggttggatttacatctgccatatcgctatttacttttttatatctcatgtcttttttgttgctttgtttctcttttactaccctttttttctattaaatagatttttataatattccattttacttttgtgtttaaaaataactttttttaaagctattttcttagtgttttctccaagaattacaatatgcatcttgatttattgcaatagacttcagactaatactaactgaatttcagcaaaatactaaagcttttgtaccagtaaagttttatatcctctcattcttgtgtgatcgttgtcacatatattaccaacatatgttataaggccaacaattaagtactataagtattgcattataaatcttttttctattaaagaagttagaagaggaaaggaaaaatgtatttacaatttcttttacatcagcctacatattcactaactctggtattcttcatttcttcttgtacattcaactaaccatccatattggtcacttcctctaatatcgttctattcctacctctactcctttgtgctattgttgtctatatgttactttatgtgttaaaaacctagcaataaaattttataactatttttgtttgcctttaaataaattaagaaaggctgctagatatttacccaaaggatacaaaaatactgatttgaagggatacatacatacatgcaccttgatgtttatagcagcattatcaacaatggccaaattatggaaagagcccaaatttgattgcctgatgaatggataaagatgtgagatagaatatcaatagaatacaatagaatattactcagccataaataggaatgaaaccttgtcatttgcaataacatggatggaggtggagaatattacgttatgcaaaataagtccgtcagagaagagcaaataacatatgatttcactcatatgtggaatttgagaaagaaaacagaagaacatagagtgggggaaagagagaagcaaaccagaaaacagactcttaactgtagaaaacaaactgagatttactggaagggatgtgaggagatgggttaaatgggtgaggggtattaaggagggcacttattgtgataagcacgggatattttatgtaagtgttgaatcactaaattctacacctgaaacaaatgtcacactgtatgttaaataactggaatttatataaaaacttaaaaaaaaaaaaaggaaacaggtatatgaaaagatactcagtatcattaatcagcagggaaatgcaaattaaaaccacaacaagatatcactttacatctattaggatgactattatcaaaaaaaaaaaagttttgatgaggatgtgaagaaaagaaaactcttgtacattgttggtgggaatgcaaattggtgcacccattaccaaaaacagtaaggagattcctcaaaaaattaaaagtagagctaccatatggtacagcaatcctccttctggatatatattcacaggagttgaaatcaagatcttgaaatgatatctgcccccccaccaccaccaccaccacattcacaacgaccaagatatgaaagcaacctaaatgtccatcaatgtgatacaggaaagctaggttcttgtctcatggagtcaaagaatgaatctcacagacaacggagagtgagtaaagtgatagaagtttattaagcaaagatacaaagaaagctctcaagtgagaggggggcagccccggttgtgcagtggtttagcgccacctgcagtccagggtgtgatcctggagacccggatggagtcccacgccaggctcctgcatgaagcctgcttctccttctgcctgtgtctctgccactctctctctctgtgtcttaaataaataaataaataaataaataaataaataaataaatctttaaaaaaagaagtgagaggggtcccaacagggttgccactgagggcttgtagaggcagtcttttattgagaactgactgggaagcttgtggccttgagattcttgtgctgtcttggtttgagtaaggaccagtgataacatctttaatggcttacttcttctatggggtctggttattctttgttggtcacagatgactgtcataaaaagacaccctccctgcccacacctagggcagggtggtctggcttgctcccttacttatctctgatttcattacacttcagcattttgtggatttctgtgagcctggttctgtggccccctacctatctctccctacctagccttgtttgtccctaactcaaatggataaacagatgaaggaaatacggtaaatacatataatggaatactattcagcctataaaatagaaaggatatcttgaatttccgcaaacatggataaacctagaagacattatgctaagtgaaataaaccagacacagaaggacaaatactacgacaccaattatatgcataatctaaaatagtcaagtttgtaaaaacagagttgactggtagtttccaggggttagagagaggaagaaataaagaggtatagcctatagaggtatagcctatgactattagttaataatactatattatatactttaaaaatgtgttaacaagatatttctttttttttaaccagatatttcttatggtaaaaatgtaacaggatattttatgataagaaccatcagaaataatgacaataataataattattaaccaattaaaagggcagaaggaaacttttggaggagatgaatatgtttatgacatagattgtgttgatgttttcacaaatatacacttatctccaaactcaccacgttgtgtatattaaatatacagtctttgtatgtcaatcatacctcaataaagtgttttttgattttttaatttttttaagattttatttatttattcatgaaagacacagagaaagaaagaggcagagacacaggcagagggaaaagcaggctccatgcagggagcctgacttgggactcaatcctcatctccaggatcatgccctgggctgaggcagcactaaaccactgagccacccgggctgcccataaagtggtttttttttttaaagaaatctatgtatgtatctttataattacctttaccagtattcttgtttcatcatgtggattaaatttccatctgctgtcactttgttttaatttgaagctctttctttagtagttctcgtagggtggattcactagcaaaaaaattcagtgtttcttgagctaggaatatcttcatttcaccttcatttctgaaggatagtttcattggaaatagaattcttggttgacaggttttttttctttcagcacttgaaatatatcaactcttattctctattggtcactaattactgatgaagagttagttgttaatattattgggattcctgtgcatatgtggagtcatcttactttgttcaagattttctttacctttgactttcaaaggtttgaaacagagatccctctgtttattttacctggatatgtagatatcttttataaaatttgtcaagatttcaaccatgatttcttctcttttttctttctgtttcattacatgtatgttggtatgcttgatgacaccccacatgtctctaatgctatttttcttcattctttttagtctctattcttcaaattggataaggtctattgatctatcttcattactgattatttcttccaccagatcagatctgctgttgaatttttcattccagttacttttcaactctagaatttccgtttggatctttttttatataatatatatctttttattgatattctctatttaatgagtagttttcacgttctttccttaacattttaagtatgactttagtcctttcaacatatttataataacttctttaaagacttcattgagcagcatctagactcgctaagagtctgttgattttttttccttgtattccttgcattttgtatttttttgttgttgaaaatcaaaattttagataatatgctgtattaatacagaatattaattctgcattctgattccccaccctccaggagtgagcgttcttgctatttgtttattttctgttttagtgacatgcttgggctaattctgtagtctatttccccacaatgtacagactatcatctccctgctcagtttcttttataattcttgtttttatttttatgcccaccttactaggatcacttttgggtcattataacttaataggaacaacagtttatcagaggttctgcttaaataccttcagccagtaaggcatatacactttggtattggatctgagtgtgacttggggaatgttttcaaagttcaaggagtttacaaatatgtcctagtttttactttctgcattcccaaggcctcatattcagtcagggttgagttagcttcctaggacactatctggttcctccttagcatgcataacctagcttatgtgcagactttcagatcatcaggcataagtgggattttagcaagattctctttggctatctttggaaccccctgtaaaatttcttttttttttttaagattttatttatttactcatgagagacacagagagagagagagagagagagagaggcagagacataggcagagggagaagcagactccttgcagggagcccaatgtgggagtcaatcccaggaccccaggatcacgtcctgagctgaaggcagacactcaaccactgaaccaccctggtgtcccaccctgttacatttctgactgctctgccattttattgcttgttccaaccagtattgtgactagttgatatgttcatcttccctaattatttgctcctaaggtcttggctgttattctacaacatcccaagacattgatttttcttcatgctctttcccaaataatgtcagctccctccagtgaagcagaggagttgccacattccatggcctagctgcctccctagtagaaattctgcaccatcaattggagttgggaggaggtgctgtttaaagaagcctctagctaaaatactacagacttctactgttgttaggattcagtttaaattcccttgttaagtgtttcccaatttttgtcctttggtaaatttccagagtctgataactttgttcagttttatcattgttttttaaatttatttaaagttattgaagtgttttcagtgtcaatatatgtgatatattttggtgtgttttccatgtgaaattggaaacaatgtgtaaataccagttgttgggatccctgggtggcgcagcggtttggcacctgcctttggcccagtgcacgatactggagacccgggatcgaatcccacgtcaggctcccggtgcatggagcctgcttctccttctgcctgtgtctctgcctctctctctctctctctctctctgtgtgactatcataaataaataaaactttaaaaaataaataaataaataaataaataaataaataaataaataccagttgttggtctatatacacttgaattatatgtcttttgatgtattggctctttcattacgaagtatctctctttatctctggtaatatccttataaagttttctttgactaatattaatgtaaccattccattttcttattagtagatgcgcaatatttttccatcctttacttttagtctgtctttatacttaaaatcccttttttgtgggcaacatatatttaaatgttcttcttgtgagaagccttgctttttaatccaatatagcaatctctgcctcttgattagagtacttgatgatatttgtttgatgtaattaatgatatggttggatttcagtctaccactgtgctgcatgttttattttttcccatttctactctttttcttttattcttttttgtctgcctttgttgacatattcattttatctcttttaatagcagttgaatagaaatgtcagagcttgagtctttaacatttgtgaaacttaactggaaaatcccagaaaggagaaatacaacaaattcaacaagttcaaattctgctttgaaaggaatgtggcttcctctttgagtcttcgtccattttgaaattctcttctgagtttcaatcaacttttcagcaccaaactctgacctatgtcttctcattctgataagactgtatgtttttgtttaagctatattcccccagcttctctttcaaaccaagaagcatcctccagggaagatctgagtaaatgttgagctcacctaactttatcttatgtccctttgctgaaaaattatctcctcatttattccacctacattgaatgatcttcagttctttcaagtagcttttaagaatcattcttttagttagactttataatttttatatgtaaaacagctagatgtagatgtatggttttcaatataagtaggtaactgttaaaataagagtagatatatttctgtgtatgtctacaaatagagtctgagatttttgacatctcaatagcaatgagtacacctaacacagaaatattgctttctagataccattctctccaaaatgaaccagagttccttggaaatataactgattctagtgctgaggaaaggaaaatgcaaatgttacacactgtaaatctatcaaccctcataaaaccttaaggggtaagttagtactatttttcccctttgtagatgagacaactaaggcacaggagaatttaaaaactctcccaggctcaaccagtaagagtcagagcttggatttaaacccaggcagcttagctccagaagggacactttcagttaatatctcttatgtcagacaaagatttgtaaacacttcaacaatgaataagtgtttcgcactctgaaaaaaacaaacaaactgacaaacttccacaacatctctcaaatctaatggacccatgctgtcaggattaaatttaagactcctggtactggctctttttgggccacatggccaactttgagggaagccttcttgagatgcagtctggggccagagactagaggtagcaaggcagccaaacagggacacttactctgtcttcctcactgagtcccttgaccaattctcttctagttgagtttacagtgtatcctgtgaagacccaacccctgcagcaccacaacctcctggtctgctctgtgaatggtttctatccaggccacatcgaagtcaagtgcttccagaatggccaggaagaggaagctggggtcgtgttcacaggcctgatctgtaatggagactagaccttccagactctggtgatgctggagacagttcctcagagtagagaggtctacaactgccaagtggagcacccaagttcgataagccctgtcaccatggaatggagtgagaagctttctgacctcataagttcctcaccaaggagggaattttgcttattcctgagtgtcagggttctctctcattacactatattttcatttgttccatgctctcttctcttcagaacaggtcattggagatagcctagtaattgtttccataaacacttaacttcctggaaggtaagatgcttggaagacagaaagaggtcatccctgttttgaacccacctgtgatatcacaggtcatggttcccccatgaccctgggcaccagtgccggcctcaagatgggcttcttttctggcactgttgctctgagtcgttcattgtgatctaaaaacaggtacatcatctataatgtagggaccttcctgacataagggaagtctgaggtaaacaagcatggagtttgtgggtaaagatcctgaggcaaatgcaggaagagcctctaaatgaaactacactgaatttgtgtgacagaaacttcatgggtcacattcctcacttcctattctcctctccaccctggcatcatgtgatgtgggttgtagtgttagagaagtctaagcaggggctctgtggctggggatattgtatctgggaacagacttgcttccacacttttaagcatatatattttccctttcttttcaggccactctggacttcagccaatgggtaatgctctttagtcctttttagagatagccttggtccctagaactgatggtagagacagcaagccaggtgacagaaataacaggactggaatgtgatcaggtggtttgcagtaaagcttcttttcaccacttaataaatggtctctaagatagcactggctcggggagacctaagaatgttcttcttactgcagggctttgacatgaggccctgagagaggggagaagctgcttgcagaggtgggtctggaacaatactctgctctgtcttctgcaggactcctgagctgaagtggagatggtgaccctcaagaaaaaaccttcctttccagcttcttctcagagtccaaaggtttccagcttggctcttattcttccacaaatacagcactttctcaggatctggtttgccctggcttcagtgaccctgcacagcctgtgttccccgatggctccctcttcctcgtccttgacctggaaccctcagtgctgactgcagtaccttatctgcattctctccttcctcttcctatgcagcccttatgtttcccttgcatgggaactcacgttctgctcacatttcgttatgagcttttctcaaataaacatggggttgagtgcttgcctttagctccgagcgtgatcctggagtcctgggattgagtcccacatcggtctccctgcatggagcctgcttctccctctgcctgtgtctctgcctctctctctctgtgtctctcatggataaataaataaaatctttaaaaaagaagaagaaagaaagaaagaaagaaagaaagaaagaaagaaagaaagaaagaaagaaagaaagaaagaaagaaagaaagaaagaaggaaggaaagaaagaaagaaaaagaaaggaaagaaagaaagagaaagaaagaaagaagaaagaagaaagaaagaaagaaagaaagaaagaaagaaagaaagaaagaaaaagaaagaaagaaaaaaagaaagaaagaaaagaagaaaagaaatgcaggttccacttcaaaatggtgacatatgaagatcctgaacttacctcttcccacagacacactggatctgtagctacaggtagagtcttttcctctgaaaagaaaaaagtaggtaaataagactggcagacccctttacacagggcaaatgaaagggaagccacatggaagcaggtaggagaggttaaggcatactctcaccataaaccccactaccaagcaggcagccacagtagaagagaactcaaaatccaaagtttctccctgaggagtgaagggattcataccccatatcagacactccaacttttaagaccagagcttgagagacaaacccccaaagcatctggttttgaagactgatgggactaaagctcatgagacccaaggagctgtagtaaacggagtgtttgaaggtagaagtgagacagtaaatttccctccaaactgaggaggcactttgagaccaggaaaatgaggcaggtgactccatacaatttatgcaatttattcagataacttactgatgagggatcaggcaggcaatgatccaggtgctatgcagctcttctctgcaatgtctggatcttagcccacaggttttatagagcaagaggatgttcaaaggagggccaaagaagtggtcaagtattatcagcactcctacagaaggaacaacttttaaagggcccatgcagactcacctgccccagggccccgcacagaaatagccctttgaaacatgcccagactttatgtgaaagagactcatttttaattttaagcattagtctgagggacaggtatgtgctggaacactctctgagtacagatgcttatgaacaccatcttcctacactacctctgccttgcgaaaaagctggcaggtacaatatttttttatttcctctttccttttttatttgccttttttttctttttatgttttcttatcattttcttttttttcttatcatttttccttcttttcttatgacagttcctatccttgcacccccctctgctttgcttttaccaatggacatcatctttgtgctctccttctgccatgttctacagcactaatatctccccaaggggagcttctacatacgtctagtgccctagtttttatgcctggtgacctggtttttgcagctaccacccaaagaggtgccccttaattacctgcttctaagagcagtgggacttgtatctcaggtttgcacaggaccaagagacagttcttaacagactgatacttccagggcactgcatagatagcatattgaaacacaccctgtctttcagacaaagagatctatttttcttggcttgtaaatttggcctgaggggcaggcttctggtttggcactcatatacagtactacagaggtgctctcaggaaacagagaccagttgatgcaatctttgtgctctacctcatttcattatagctcaccagtatcttacagaaaggagcttatacccttctttggtgccctattttttgctgctgccaccagtggatacctctactttatctggctctggtgactaactggtcttaagcttgcaggtaccacagaactgtaacagagaaagagttctcaagtagctcctaccctcagggcacaacaagaggcaggaacccaagagctcaatttttcttcaaaacaggtgtattagtttatcaccatagctgtagcctaaggagcagatttctaattaaacacacatctaagggttgacttcaaccttccctgagacctaaaagggcaggcattatccttgtgctctccttctcacctccaaatagcctaagggttttggggccaatgaggcttacacttgcatgtacaggcctgtatacatttgcattctataaaagctactatctgaggagctggcttccaatcatcctgaatctagatgctgactgagatcctccctttagggacatgggttggtcttggcacaccctcaactactaggagctattaaaaataaaatagtctgcttgtacaatcacaaaaatttgcaagacaacctagagctggggaagagttgaacaatgaggtttacttctacataaggccaacccctcaagactaggggagaaggctttttcatctaatgcacggaaaccaacacagagagtcaagcaaaatgaagaagtatgttacaaacaaaagaaaaagataataactcagaaaaaaaaccttattgaaatgaaaataagtaatttacctgaaaaaacaatgcaaagtaacagttataataatcctcattgaacttgagagaatggctgaacacagtgagaaaatcaacaaagaaatagaaaatataaagaagttccaaacagaagttatagaactgaagaatataataactgaatgaaaaaaaaaaaaaaaaacactaaagaggtccaacaacagactagatgaagcagaggaaaggatcaatgagctaaaagacaggacagagaaactagcctgatgagaggaggaggaagaggagaagaaagaggaagaaaaaaagaaataaagaagaagaaaagaaaggaaggaaggagagaaggaagatagcttaaaggatatgtggcacaacaaggatgctaactttcacattatgggggtcccagaaggagaagaaaaagaaggaggcagaaaacttatttgtagaaataattgaaaatttctctaatctggggagagaaacagacatccagatccagaatgttcagacagttcctagtaagataaatccaaacagccctacaccaagcatgttataattaaataccaaaagttaaagacaagaagagaatcttaaatgcaataaaaaataaataaaataaaaattaaaagcttattaccttccaggaaaccttcataaaactatcagcagatttttcagcaagaactttaaggagggaagggagcaatatattcaaagtgtcataagaaaaaagatttccaaccaagagtttccactcagcaaagttatcattcagaattaaaagaaaaaaggagccctattagtaacaaaacaaacatgaaagtataaatctcactggtaaaagtacataaatagcaaaagcactggattaatacataatttatgaacctagtgtagaggttaaaagacaaaagaagtaaaagaaaaaacctataattacaataattagttaagggattcatgagataaaagatataaaatataacatcagaaacatgaaacgtgggagaagtataaaattgagacctttagagtgtccaaactgttataaacttaaaatagactgtcattatatatacaaggagtagtggaaggggaggtgggcaggggggttggggtgactgggtcacaggcattgagggggacacttgaggggatgagcactgggagatatgctatatgttgccaaattgaactccaattaaaaaaaaaagaagaagaagcaaatgagcaaaggaaaaaagagacggaaagaaaccaagaaatatattctttaactccagagaacaaaccagtggttcttagaggggaagtatgtgggggcggggggggggggggatgaaacagatgaatgagattaagagtacagttattgtgatgagcactgagtaatgtatagaaccgttcaaccactatattgcactcatgaaactaacataacactgtattttaactatactagagttaaaatttaaaaataaaatcataaaaaagattgttaaatttcttaacttttccaaatggtttttttattttatggttaatctagaatcatgatggtgtgtctcattttgacaggaaaactcaggttttttttcaggtcatccctcatttattgagaattctatagacaagaaggcctgtgattgcctctcctgccttatcttccccctcccacagcacactctggagcccaaccctaagagatcaccacaattcactggaacttgatgaaaacaaagaagtcttcctgaaggaactagtgggcacaagtgcagtatcaagccaaattctgttaggaacagatcatggaatcttactctcttagaaatcacatatgcacaattgaccaataatgaattgcagaaaatgtgcttttctatggacaccagagggagaccatgaaagtctttcactgacaatctgtcaaaaattatgcctccaaaataagggcaaaacacttaacagtagaggcaaagtaagactgatgtgatctacactgctgcttacctcctaaatcagaatataaaagatactggagactcctgtaaccaaactaatgtaactggggcccaggggtgcatgtgttgcggcccagaaaaatcaaggccattccacctcaggtttagcgttagcacaagtacagccaccccaggcccctgtgaataagagctgaaatttacattactagagttacaggaagaaaacagcttacagcttaacgtcctagaaagcccctattagaataagaacagagcccaagccaagggcaggaagccactattagaataagaacagagctcaatgcccttgaaagccccatatcaaaatgtaaacagaacttgagaaattcctccaccccttctgaaaaaaacctagaccagcctataaaaaacccagctgtaacccactttggggtccaagtccctgctccactgtgtatacttggacccaagctcgagcttgtaaataaacccttgtgtgtttgcatcagtgttggctccttggtggtttctcagattcgcaatcttgggcacaatacacgaacacttggctccagggggtcccaaatagaccaggttcagccaattgccactgacaaaatccaccgggagagagactagtggtggtgaaacaagaaaggagtttatttcaatgaagccaacatgggaagacagtggactggcctctcaaagacatctccaaagtgctgaaaaatacttccaggtttatgagagaagtgtggggcaaaggttggtaggtacaaacaggtgggcagcagaggtcaggtcaatcatcgtactgggggcagtcactgcagtcttgctggctcaggctggcccttagtggttgaagaggtagttttggctctcattacatgatgctttgcccacagggtcttttgcctgaattaagagataaaccagaaggaagtacttaatcagaaaatttgaggtcaaaatggaggaggttgaagtcctctttcactaatgttgagttcactccttggtctgttacaaatacagactacatcaggtggagttgtcacacaaaggaaattttatttgcagcaaaccaggagcttgtgggggataacttcaaagtcaagactcttccaagaacactgagaggttgttgtttttttaaggtttaggatgaatattcagaaaagaatcttcatcatcacatgtaaaggcaggcttgagatgctctggcatacttaaaaaatgtgtccatacctgcatcctatgttatgttaatgagatttgtgcccctcctagggacaataagcagaggtaactcagacaaggggaggcagagagtccaaggagatgtgatgacaagcagaagtcagaatgaagcaattgctggagaagcaacaagtgaagaactcaaggtggcctctagaagcttcaagagacaagaaagattctcctctagagcctccagaaggaatgcagacttgctgtaccttgactagtcccatatgacctatttcaggcttataacctccaggactgccagacaatgagtttacattgttctaactcacttaatttgtagtcattttgttacaacagaaataggaaacagttacatcttgtaattgagaagcaatagggctcagagctcaagttctggagtcaaagagatttgagtttttatcataactacatcacttcctattcatatgaacttgggtgtctgtaaacctctctaagcctctattttctcaccagtaaaatgggactgcccaataaagtctctgcctggaaagagaaaatagagaggcagtgaggtctgctgttcttcataacaagcctgatacctgatattttaaaccatgtctatttataactttgtttaaaaggttaaatgatttctggggccccagggtggctcaggcagttaagcatccaactcttgatttcagctccagtcatgatctcaaggtcctagaatcgagaccttgtgttgagctctgaaccatggtgagtgtgatgcctattcaggattctctctacctctttctctgtgctccttctccccttgtgttcacaaactctgtctttccctcaaaagaaaaaaaaaaggttaaatgagcccaatatattaaaatacttagggaaatatagaggggggggggactttcatttctattttctttttttttaagattttatttatttgagagagagagagacaaagatagcaagagaaagcatgagcagagagaagcaagctctccactgagcagggagccaaatgtggggctcgatttaggatcctgggatcagagcctgagctaaaggcagacacttcacccaactgaaccacccaggcgcccatcatttctatttcctaaggtgaaaactctgatgcatttcatttttaaacccctttttaaaaaagtaaataccgtacttgtgagattcatagaaagttgcatataattaatattaaatatacctgaatatatgttctatatcagaatttgtctgctacacatttaattatggtattacattaaatgtcaaaaatatcctgctaaattatcgctgcagctgtgtaacttaagaaagtttaggaaattgtcagcaaaggaaatggaacctgacttctccttttctgtgcaacaaaaaagcaggtgaaatatacaagattctgagtgttcatcatacaattaactcaaaacaattctaatgtcattctaatatactaagaaactggcaaatgtcaatcactctactggacagtaagctatataagctaagaaaatcacaagttctgacagcagaagaaagcaaaaatttaaaaaaaaacttgtcaaggatagaaataagtgcaaatggatcatttgagttatagaacatttggataataaatcagatcctttttttttttttttgaatcattcctaaagttaaaccccattataacttttgagtgcttcatatttttttgtatatttttattggagttcaatttgccaacatacagaataacacccagtgctcatcccctcaagtgccccctcagtgcccgtcacccagtcaccccaacggcctgctcacctccatttccaccaccccctgttccttctccagagccaggactctcattttctgtcaccctcattgatatttcccactcattttctctcctttcccctttattccctttcactattttttatattccccaataaatgacaccatataatatttgtccttctccaactgacttacttccctcagcataataccctccagttccatccacgttgaagcaaatggtgggtatttgtcgtttctgcagctgagtaatattccatcatgtatatagaccacatcttcttaatccattcatctttcgatgacactgagcctcctaccacagtttggctattgtggacattgctgctataaacattggggtgcaggtgtcccggcgttgcactgcatctgtatcattggggtaaaaccccagcagtgcaattgctgggtcgtagggcaggtctatttttaattctttgaggaacctccacacagttttccagagtggctgcaccagttcacattcccaccaacagtgaaggagggttcccctttctccacatcctctccaacatttgtggtttcctgccttgttaattttccccattctcactggtgtgaggtggtatctcattgtggttttgatttgtatttccctgatggcaagtgatgcagagcattttctcatgtgcttgttggccatgtctatgtcttcctctgtgaaattgctgttcatgtctcttgcccatttcatgattggattgtttgtttctttgctgttgcgtttaataagttctttatagatcttggatactagccctttatctgatccgtcatttgcaaataccttctcccattctgtaggttgtcttttagttttgtggactgtttctttggctgtgcagaagctttttatcttgatgaagtcccaataattcatttttgcttttgtttccctttccttcatagatgtatcttgcaagaagttgctgtggccaagttcaaaaagggtgttgcctgtgttctcctctaggactttgatggattcttgtctcacaattagatctttcatccattttgagtttatctttgtgtatggtgtaagagaatggtccagtttcattcttctgcatgtggatgtccaattatcccagcaccatttattgaagagactgtcctttttccagtggatagtctttcctgttttgtggaatagtagttgaccatagagttgagggcccatttctgggttctctattttgttccattgatctgtgtgtctgtttttgtgtcagtaccacactgtcttgatgatcaccgctttgtagtacaacctgaaatctggcattgtgatgcccctggctctggggcatctttttcaatattcccctggctattcagggtcttttctgattccacacaaaccttaagatgatttgttccaactctctgaagaaagtccatggtattttgatagggattgcattaaatgtgtaaatttccctgggtagcattgacattttcacaatattaattctgccaatccatgagcatgcaatatttgtccatctctttgtgtcttcctcaattcccttcagaagtgttctgcagtttttagggtatagatcctttccctctttggttaggtttattcctaggtatcttatgcttttgggtgcaattgtaaattggattgactccttaatttctctttcttcagactcatttttagtgtatagaaattccactgattcctgggcattgattttgtatcctgccacactgccgaattgctgtatgagttctagcaatcttggggtggagtcttttgagttttctatgtagagtatcatgtcatctgcaaggtgggagagtttgactttttctttgccaatttgaatgtcttttatttatttttgttgcctgattgctgatgccaggactacagtactatgttgaatagcagtggtgagagtggacatccctgtcttgttcctgatcttaagggaaaggctcccagtgcttccccattgagaatgatatttgctgtgagctttttgtagatggctttaagatgctgaggaatgttccctctatctctacactctgaagagtgttgatcaggaatgaatgctgtattttgtcaaatgttttctctgcatctattgagaggatcatatggttcttgttttttctcttgttgatatgatccatcacattgattgctttatgagtattgaaccagccttggatggatggtaaaatccaatccttggatggataaatcctacttggtcaaggtgcataatcttcttaatgtattgttggatcctattggctagtatcttgttgagattgagtgctttattaatggaaattatatccacttgaataaccttaaatgtaggcttgaccctcaaaaaacatggagggtttgtcttaaagaaagctcaacccaatggaacacttcaggaatagatggtacaatacatgacaagacataccccagataataaagaacaaaaatactgtgtatccaagtacacataccacatacttaagaaaaaaaggctttaggaatataaaagggaatcaaatgtgtgcactcatcacaaaactaaattgtatgaaggaaaaaaaaaaaactaaattgtatgagccatagaccacaagaagtgcttatgtacctgaaatagtaccaatttgtattgaaaacctgaaaggaagtaaatatatgaccgagtccatgttcaaagctgtatataggcattaaatggaaagactatagcccaactgataatcagtagaaaaggtagctgtaagaaaagtataatccaagttaatgaagtacatatctagagtactaagttacatagttcagaatccatttaggacaaaatgctcagaaaagtaagaatagaaaggaacttcgtcaacttgataaatagaatctacaaaaaattttacagctaacatactcagtggtgaaagactagatgctttcccccctaagactgggaacaaggcaaggatttctttctttttttttttcggcaaggatttctactctccactctcattcaacggtactgggacttctagccagtgcaatagcaagaaatggaaataaaaagcatgcagattgtaaaggaagaaaaaatattgtttttcttttcagacgacatgattggctatgtacaaattccaatgaatatacatataaactactagaattaaaaattgaattcagcaagttgtatgatataagataaacataaaaaaaatcaattgtatctccatatactagcaaagaacacacaaataccaaaattaaaaatataataccattttaaatcacttaagcctttctggagatggcccataagagcatgcttcttgcagaagatctccaaaagaaaagaggaaacacaaaagaagcacttggcaaagagccccaattcttactttatgggtctgaagtgcccaggatactataaaattactacagtctttagccacgcacaaacagtagttttgtctgttgaatgttccacagtcctctgccagcctaccggagagaaagtaaatttatagaagataatccttcagataaatgaagcactaactcaccctgaatcaaggtgagtgggaaatcattccaataaacacattatagatttgaaaatcactcagaaatgaaatgtgtaggtataattctaacaaacatacaaaatttatatgttgaagactacataatactgttaaagaatatctaaataaacagagagacattagatatggacaagattatgctaaagtttatatacaaaggcaagagaattagagcagataaaaacaattttgaaaaaaagaatgataatgggaagaatctctctgcctaatttcaagactgattttatagttagagtaatcaggactgtgtgatattggcagaggcactcacacatagattgatggaacagaataaagagcccagaaacagacccatgcaatatgctcaacagatttttaaaattaaaaaaaaaaaaaaaaaaaggatcacagactaatgtgtaaagtgtaaagccataacacttttagaaaaaaaaacttcaagatctaggactaagcaaaaagttctcagactagacaccagaaccatgattcatacatgaaaaaaatacaaattggatttcatcaaaattaaaactttgttctctgcaaaagaccctcttaagagaatgaaaagacaagatacaaactgggaaaaagggatccctgggtggcgcagcggtttggcgcctgcctttggcccagggcgtgatcctggagacccgggatcgaatcccacatcgggctcccggtgcatggagcctgcttctccctctgcctgtgtctctgcgcctctctctctctctctctgtgactatcataaaaaaaaaaaaactgggaaaaaatatttgcaaatcacaaaatatttgcaaatcacataactgactaaggactagtcctagatatgtatgaagaattctcaaattcaacaataaagggatgcctgtacagctaagtggttgagtgtctgccttggctttggtcttgatccccgggcagtggagtttcacatagggctccccacagggagcctgcttctccctctgcctatgtctctgcttctctctgtctctcatgaataaataaaatcttttttaaaaaataaaaaataaataaataaataaataaataaataaaattgaaggagattaatttcatatataaaaagagcaacagaaaacgactgaagctgtatcttttacaaagtgagtataaatatgaagagaatatggaatggaataagatccttgcagacagagcacaccagaaaaatcatgccaccaaaaacactaaactataacctatttcaaaacaacctgaatgtcattaggaaagtgttagaagatgtgaaatagcaacatagatcagaattagaagatctcaatacagacaataatattgtattataagatgtactataatgatgtactaagtattgcttcagtgacaatcataccacaatatataggtatatcaaaataacacactgtacatttgaagtttacgaatgtagcatatcaaatttatcaaataagaaaataatattttttgggatccctgggtggcgcagcggtttggcgcctgcctttggcccagggcacgatcctggagacccgggatcgaaccccacgtcgggctcccagtgcatggagcctgcttctccctctgcctatgtctctgcctctctctctctctctgtgtgactatcataaataaataaataaatttataaaaaaaaaaagaaaataatattttttaatttcagaaatatgatgacagtactcaggagataattagaaataaaatccacttcagaaatgaagaaaaaaaacccagaaaaacaaatagacataatggagaaggcctcaacagaaagaaggcaaaaagaaaaaaaaatttaaagaaagaagaaatgagaggtaaagaggatccaaaagaaaatgacaaatattgaagatatgcaaaaaaaaaaaatctaatatgcaaatgtaggagtttctaaaaaaggaaaaccaaagaaaatataaaaaatatcactcaataaaacattcctaaaataaaaaaatatttgaacaatatatagaaagagaatatggtgggatgcctggatgactcttgatttaagctcaggattgtggtatacagccctgagtctctttttctttctttcttctttaaagattttatgtatgtatgtatgtgtgtatgtatgtatgaatttggggtgtgaatagggggaggggcatagggcaagggagagaatctcaagcagctccctgctatgcacagagcccaacacagggcttaatctcacgaccctgagatcatgacctgagctgaaatcaagattctgacacttaaccgactaagccaccccaggtgcccctgaaaaatctgtttaatgtctcatttagtaatgactcacttggtcataaattcttctacactcggtctgcaccaatatgttgtttggttaaaacacatacagaaaatgtggcctcactcagatggaaagaagggaaaaattttaatagcctttcagctattgtgtatattctttgataagatggtaaaactcaacaaatggtagatttttacaaattagttgcagtgtggaatctgaaatcttatcaatggtcttttcatgttctgttatgttaaaattcattgatctaccttgcactttgaatggaccctttatgcttggtaatttagcagtaccatgaattgatcatttggaaaggggttcacaggattatgcagatctccaaaacgttgacacagttcactaaatatgaaaaaagcatatttggtaatatcaccatcaatctcatccaaaaaaatatttattattaggaagctggggcaaacacaagttttcaaaaattttaatttttctctggaaaatatgactttcactgtcaatatcattttctttgaagtgaccggcttcttttgcttatttttgagaaaatgtctaccaaaaatattaaataaccacagtgtgtctgtaagtcactctttgaaaaattgcagtccattagaaaaagaagaggtgactagttttatctagacgtcaagcaattacacagtaattttccacaatataaatgtgtttccatcactttggagaagaaatactaattttgccacactgtgtattaaaaagatgcctacttgagattcaatatttagtaaaactaatgatttttattgcttcaccaaagctctctttaggtaaaactgacattcttgaagatttttcactgcaagtacatggcagccaagaacaccatgactacttgcagaatttagtgtcactgcctggattcgtgctacagcaccaggagttttacccactgtagattttgcatcatcagtacaaatacagtgaaaagggcaagtaagagcttattattattacaaaaatagttttgaccttgcagatcccccaaaagggtctcagtgacctccaaggagtccacagaccacaacttgaaaaccactgcactggagagacactgacacaatggaatagtagttagcattaaacacgttattattcacagaactaagactaaaaagggagcaagtatcctctgtaatggtatctgatccattaatttagatataggacaactataaaaaggggaatgatgaggagaacaaagcaaaggaatattaactattttcagtcatcattttggtggttacagtatgggtatcactatcctcagactgccatgtgcgttcatttggtaaaagcaaatgagtacgggtggatattctaattgtatgtattcccatgtctttgaaaaccagaattgttgatgtggaagaaaggaaggagacacaaatgtaatacagaagagattgattttttatttatacatatataaactttatacttctataaatatgaatattgcacataaacatttatatttccaccagaaagacttgatatagtgatgtctttatggttttagtgacatttcctattaaaataagccagggctttctaaaacaatggctgattgcagttctgggcaggaaacatacagaataaacctggaacatcttgtcatataacagaaaacaaagaaactaccaaagatttgtgtcaaaaggacttgggagccacttgaagaagtttccgtgcacctaagatgatactattaaactcattgctaaaaactaccgtgagctaaaagccatcaaatacattcaaatctttgaatttataatgatacaaaaaataaaaataaaaagtaaaacctagctgctcgccttaggataacagtaggaaccaaattcattaacttgaaaatgaataaagggaaaaagttaaacactgatcttttctttccactgtatcactgggcaacccaccagtaaatgaagggaagtgtctccttacagaagcaataaagcatacaaatgaagaaggaatgacagaatgaggatatcctcattctgcagacccagtgaaggaaagggtctaggcaaggagcactaacagtgacacaactggacagtgtgtacctcatgatgaaaaaacacactgccacctgcagacttgccaaagagattaaatctaactgtatccagcctctgcatccagttgccaacttgcagaaaatgcagagaatggaaggacatgctaaactgcaccaggtgcgtgcaattggtaaaatccagactgtgggaaactctgcaggtcaaatgctccaggcttttcaaaatattaatcatcccaggcggaaagggatgcaggagaaacctgtaaagtatgaaacataaaagacaactaagctatgctatcatgaattcatacctgagtgaatagggaataaaataatacaagtggttagtctgacagtcagaataggattgcttttgagaggagggtgaggggtttgatgggtctgaggcacatgcagactcttgcagggctggtaagttctatttcttgatctgagtggtgatttcagggtttttcccttcaataattcattaaattctacattttgtgtggttatcttcatttccgttttattaacaataaaaaaattcattaaaaaaaacagtcaataggaaacagtgcctctgagcatttgtcttctagagtggaaagaggaagatgtgaagataactcacagggttagggttggaccacaggaactatgcagtttggggctctcaggagccagctctggggggaatttctgcatgctgtccttggaaacagagattaatgacacaagaggaagaaggacagaagagtgagagaagcataatctcagaacacagaactccagaatctggtcaggactctccaaggcctcgtgcaagctgctccagaaccttgacctcatgagtgccccttatgtagtccagggctcaagcctctcagtactacttcaggctccggggcaggaagctttggttgggaacctagcatggctatggtgaaggaactgctcttgagatctgcagggacagtgatcagagtctcaggagggcccgcactctcccattccagagactcagcacccagtgacacccagccacggccgccctcacatcctacccccaagacatctccctctggctaaagcactgggagaacaatcagccatccaaagagaaggaaaaagacattacctcatcaccagaaaactgagtctccacatatcctagaatgagaggaaagaaacagaatgcccttgttagaaccaaatgttgtgattatcctgaagggagggtgatgacctgaaatatcagaatgccatttctgcagaccccctgaaatatctctggcttcagaaaagactatcctggtgatccctgagaagtacaatcagctttccctgtctcatatctttgaagttaggggaagtgggagtgggagaagccacagggcaaggggcaggatactcctgagaggctcaggtacctttctgagccctgaggcagatgacagtccccaccagaaggaagatcaacccaagcaggaaggctgcaattccactgagcatctttctccaagaatatgtggactgagctcctgtgggaaacagtcttaaaatagtaaaaaagctcccatatttgatgtgccttcctgggattccgaccctgtactgtacactaagtctagtgctatctagagaagaaatacatttagaaatggttctttgaagccaaggtttgcccccatggaatttctgttactgaatcttgcagcccacaagaatggcccctaacatactaagacaaagtattagaggatactacttctcacagctggaaataagtgatgaggtggttagatctccttctttcggaagatacaaggatagctatccaccatgtcttctcctcccctaacccaaagaccccaatttccatgactccctcaaatcaggggaaagaagcaaaagtgttgggaccaagatgaatgcagaggtcacacaaggccctgtgctaagtcatcattactctgagtcgaacccagagagtacaagaatctgattctcactccactccacagaaacagggctcagcaagctgggatgattaacaaggcaggtgtagacatctccaagttcaggagtcatttccagcatcaccattgtctgaaaggtccagtctccattcctgataaggccagtggacatgaccccaactctctcctcctgcccattccggaaccacttgatcttgatgtctcctggatagaaacctgtcacagagcagagcagcagattgtggtgctgcatggatggggtcctctctggatacactgtcacctctggttgtactgggaaaggagaaaaaaaatgagacactgtgaaggaaaaccaccatgccaggacaggagttctttgagagactacctctgcccctaatctccttctcacaccacccaagtagaaactggaaaaggtaaggaaatgtctgcccccaagagtcagaaactgggtatgtcaggacctcaaggaggagttaggccttatcagatactcccacaattaccccttctatttgagaccccactggtccttaacattcttgagaactttgggggtctgggaccaagaccaaagtgacctgacctgtgaggataatgagtgaatcgcaactggggacagaacatatgcccagaatcccctgctcataagtcatttattctgaagctggaaattgcctatcacaggaagtaaagcccatgatcaggttcatgtgtgggagattcctgaaccccaccagacttcaccttccacctcaccttttctccccacagtgaagggtgcaccgagctcgtagttatgcctgcagagtaaatccacagaagctctactcctctccaatatacccggctgactgttccagagctcagcatcaggcttccccagctctgtcaatgccacaaacattcccacgtggctgtcaaaacgtgcatactcctccaggttaaaaatgaatctcactacaaactgcaccttctctgttccattgatgaagtaacagtcagcctttgcctgaatcacaaaatcttctggaaaacaacagcaaaaaaaactataaaccaacctccacctttaagaaacccatacatagtaaattatgccagatcacatggatttgagaggaggccttttgacctcagtaaatagttcaaagtatcctcttctctcctgagtcccactccagttccatttagcaaaggcacacccattgtggaaagaagcctgacatccatcctaccaggccagccaaacagaagacatgtaacccaaaaaaggcaagccaaagagggagttccaagagacataaatattcattccacaaagatttcttgaccattgttttgctgacactgtgctggtttctccaagccaagttttcagaaacccaaggtttttacttccctttgttatcaagtcagaaccatccatcccaaaatgaaataattcaacggtactcttgtccttagcaagttcattctatacattccatctggagtgaagtgaaggagtgatgggggtagggggttgaaaagaaatacagactaggtatacatttgatgtgaaattaactcccatcctacttttcactcactatgggttttctccaagaattcctttatttttggacctttccctttgcacttttacttaaagagctcacccctctgttggctaaggtaatgatttcattagttttgttggtgtgaagtaaaataatactaacccatggctcaaagattaatattatcatcagcatcattggcactatacctaccattccagtagctacaacaacatggtgactgggaatacctggttagcttaaaccttctttgggggtttttacatgaaacatggccactacattgtccattatgattttctactttcggagcaccttactaatgttgatagggattagtttgagctatatatttcttcatagtgtctactctgcttatgttcttcaatgtaatttaacactcaaaaattatgtaatctgtcctcattggtaagaaaaagtataattcttattcactgagtacacagtctgagtgtttgggcccctccccgcaaattcatgtgttgaaatcctgacccctaaaggtgatattatcagcaggaggtgcttttaagaagtgcttgggtcagcgggttggagccctctctcatgaatggggttagctcttataaaggaggctccatagagaccccaagcccctcctaccacatgaggacacaggaagaaggtaccaccttctccaagaagacagtcttcaccagaacacagccatgctgatgccttcatcttggacttcctagcctccagaactgtgaggataaatttctgttgtttataagccatccagtctgtggtattttgctacagcagccagaatggacagagacacaatgatatctgtcatagatttgaagatctgaaaaattctaagtgacaaattggtaaatggtcctgggttaagtttccattgatcttagttctagttttatatctagcagttttacacagagccacttaccctccctgacctgctttcccttgcaaacaacactgaagctgagctcgaaagcatagtgttaagtgacaaaagaagcagaatttggttcaatgtacaatgacatttattaaaattttaaaatacacatgaaaaacaattctgaatatccttacaggccagcctcatagttaaagttacatcagacacattagaatggaattgtaaggaaaggagggagtggaaatacagaccaggaaagaggagagagtcctttcttggaccaacaaatgattgcaaagtgctgtgaacccactgggtaagactgacgcaattctctgtatgcactcgagaacaacaatactaaaaggaaactcaaatgggttgataatgtaggttggtcagaaaagatctccctgaagaagtggtatgaggataatcgttaacgaccccgagttgtaaatttgctttcatttctaaattcagaggtctcctccaggaactaatgagctgagcgttaaggactactacagcatccttcctggatcagcacttagcagctaaagtcagctgtaacctccaatgttcttccttctaacagtttaaatcagaaaaagaaaattatctgggtgtcagatctgtgtatgtgttaagacctgttctttaacggacattgtaagctcagagaggtttctattctaggagaataaccatcgtctcctacccaccctgccctcccaggtttgttcctcttttgtgtttaatgagaccttgacattcaaacagcctctgtttttaatgcattatatcctgttttctactgataagtatgttttcagggtgtaatactgtctcatattcgtgcagcccatctccttggctagaaaaataacagcaataaatacacatatccaggaacctaaggaaggcataatgcattgaacttctcttattactcaaagctggggttaataaatgccaaaagaataaatctttgtatccaatttctttggtccacatgtatctcagttggatagacataaaaagagttgcaatcatcagagcaactcctgttggaagaattatgactattctcagactgcccccagtttatacagttcttgagactgacactgatattataaggaccctaagcaagacaaaatgtttcccttcttcctgctaccctactccttgaagctgaggctctgctgcaggatgttccctttttccagcagtccattgtgtgtggtaaagagggaaggcatatctgaatttcaaaaggaataacactttgaaaccagaagccagttccagtctgggctgcagcctggacctacagggaaaagcatccatcctccatgccaattcttgcatacatacctgggaaaaaattgctctgctcttacctggagagtctctgccttgagtcatggaagaatccaatccagttacattcactaacagagccagcatccatggaacccacccagaacccattctggaaggaaaaacaaaaaattaaacagtaaagtcatcaacttcttcaaaatggggcttaccccctcaaaactcagtcaaaaatatttattaagagtatgaatacctttctggcttccccaggattggaaactcttcacactgataaccaatcatgatagaagagttttgcatcattaggtgctgggtagactactctcataaagtcatgtataccactcaagaattgtttacctgcagaattactgatggtagtttaatgtgtgtgtggaaaatgggctgtgagacaaaaatgttttaaatagtgtacatagtatgtggtcctagaagaaccatgtagattgtttactatgcattctattttttaaccaacaagcctcttctatggttgacattgccaacagagtgtgcaaataaagaagaaggtagacatgattctgaagcatttgcctcaaggggatttaatgaagggattatcagagaagatatagaagagattgagaaccacctggagagtatgatttcctataaaccaagagagggccacagaaaagaaaataaagagaagattctcaacagaataaaatgctgcaaaaatgttcaagaacattgaactcaatgtggttcagtcagttaagcatctgcctttggctcaggtcatgatcacaaggttctgggatcgagccctgagttgggcttctcactcagcatggagtctgcttagattccctttctccccctacccctctcacttgtgcagtctctctctctctctctcaagtaaataaataaaatcattttttaaaagagttcatttacttattcatgagagacacggagagaggtagagacaggcagagggagaagtaggctccctgaaggaagcctgatgagggactccatcctagaaccccgggatcaggacctgagccaaaggcagatgctcaagtactgagccatccaagtaccccaaataaagtctctttaaaaatgttcaagaggaaaaaaaaaatgttcaagaggataaaatataagaagcattattgtgttttataattagtggagcaccaacaaccttcagtaggacattgagtatttgaaatgaaggcagcagatataaacagcccttcaagaatgtgaagtgaagcagcacctgggtggctcagtggtcgagcatctgcccttggctcaggttgtgatcctggggtcctgggatccagtcccacatccggttcccctaaaggagcctgtttctcctctttctccttctgcctgtgtctctgcctctctctgtgtgtctctcatgactaaataaataaataaaatctttttaaaaaagaatataaagtgaaaacaagggaaaagatggtatttaccttgaatgaaaagccacacaaaagtaaagttacctttaagaaaaaccttaacagggatccctgggtggcgcagcggtttggcgcctgcctttggcccagggcgtggtcctggagacccggatcgaatcccacgtcgggctcccagtgcatggagcctccttctccctctgcctatgtctctgcctctctctctctctgtgtgtgactatcataaataaataaataaataaataaataaataaataaataaataaataaaaaagaaaaacctcaacagcgaaatgggggatgggtattaaggagggcacttgtgatgagcactgagtggtatatgtaattaatcactaaattctgctcctgaaaccaatattatactatatgttaaccagctagaattattttttaaagatttatttatttattcatgagagacacagagagacaggcaaagacacaggcagagggagaagcaggctccatgtagggatcccgaggcgggactcgatcacagtattccaggatcacgacctgagccgaaggcagatgttcaaccactgagccactcaggcaccccactaactagaatttaaataaaaccttgaaatagaaagaaaaaaaaaaaggaaggaccttaatgagtttctcagtcaagtagaaggcatctgtacatgggagaaattgaagataaaaaagagaagaaaagagaaattacctccagaattcctaatggaatccaaagagattgtcagacctggttataaaaaggagcacttgttcagcaactagactgaagacagggggattggaagcaagaaagaggggagtgaggaagttctagttgtatgacttcaatggactccagttaggacaaggcaaaaccttctgctagaaaggagttggaagaaaatctttttaaccaaagtagtctataagtacatttttatttatttagcacacagtcatctatgaccaatattatgggttatgcagtaatgacacagacatgttccttgttctcaagaaatatatagcctaagcaaagtgacaaggaaacaatccactgtgatgtcagaaggaatgagatgaatttggcaatgtctgggtacataaaaagagtacattttagcttaatatagagttcatgataaagttgatagttgatacaagtgacataacaagcagagatttttagaatttggaatacccagtacatgtggacaaatagaaagcagataaacagtgaaacaaaaagtttatctggattctttcaaattcctaattgtctgcaataagtaaatacatgcatactacttcattgaataggaacagatagggatgcctggggggctcagcagttgagtgcctgccttcagctcaggctgtgatcctggagtccggggatagatcaagtcccacatcaggcttcctgcatggagcctgcttctccctctgcctatgtctctgcctctgtctctttctgtcactctctctctctctctctctctctctgtgtctctcatgaataaataaataaaatatttttttaaatgggaaaatatatggggttttttttttcatttccttaagagaacacacatgctttgatgggtatgtaaggtaggattatgatggtagttgaccagaacacccaggaatacttgagttatgctttgccaaatatgcttggatgccctcaggaaatctctacccataagtagtaataccaacttgtaaattaaagactgactctattgttaattggtcaactctctaataccccaacagaaggttttatggtaaacttctctgaagcatgaggcccaagtaagttctcatgttccctcttaaatcccacttgtaccactagccagctataaattctgaaggactaagaactccccaacataagagtaatagtttgggtcacaaaggagctctgttcaagatggcaaaaataggattcagaaaaaaagtgaaatgtaactacatacatttaagtactgtggcccttgcactttgagtaaatatgccctgtcctggaatctgaccaatcaaaataataattccttctcctggaaaaagatgaggaggtgtggaagacatcactagtgttcaccaatatcttctacttcctgggcacatggaaaattgtatttcctagtttcccagaactatgtgactagttctagacaatagttagtgaataaaaaggttcttagacaaagattttagctacccttgcatgacttttctctttttcccttgccaagtcaaccaaaacaaccttgtattgaaatagtagaatcagaatataaaagcaatgagctaattagcagagttatcataaagaggagaagccctagagaatcacccaaacccacaatggatgttatatgaatgagaaaaaagttttgcttgtttaaggctctaagggctgttaccacagcttggcctaacttatcctaactaatataggacgagaataagattgttgacctgcccctccacatccctcaggtatacttgaatattcatgagttagaggcctgagcacaggcaaaactgggagactctgtccacagagtataggacccatgactgtgggtacatcttctagaggtgaatggttgtgttgctcccatttgtgagggcacatgtagagctgattgaaaaggtgacaatcagaggaagctcaagccacagagctttaacttcctctcttcttcttactcacaccggccttagtctttcccatgttattttatctcatctggaagtggagaaaaatattttacttgaagctaagtgaatgagactctgacatggagattatcagaagcagcaaaggcatgagacggcatgctgccactgaggcaagaatgctcctcccagggcatgagaaaagagacggtagtgtccatatagggttgccaacctaattttctaagcttttgaaagagggacacctgggcttgtattttggaatacttttgaaagctcttttaaggtataatttgtgtaattgacatgcaacaaagtgcacttatctaatgttaacaatttgataagtttttacatgtataaagtcatgaaactacattgtgaaaatcaatttatctgtcacccacatttactttgtgctcatataatctctgccttctccagccttccaggcaatcattaattttctttcctttacattgggttagtttgtattttctataaggcattattaagtatatggttgttgttgttttttttctgtacttgttttgcttcattctgcatgcttattgagattcaacgatgagcttattatcttatctgcaggcaatactgtagttggtcttcagccctttctctcaaggatgagagagagatcttgaggagagaagaaagagtgaggcctagaaaacacagataaaaggtgtgcttgtctgtggatttagaggaagagaaagagttgatagatggcaagagatgctgaggggacactggaggatgtgaatgctgaaccaaaaagttaggaaggttgttcttttctacttctggtgtgaacatgtctaaggctcataaactctaaaatctgacttaactacatcatgatcataatagctaatatttattgatcatacattgtgagtcaggtttttttaattttagaagatatttatttatttatttatttgagagagagagagagagagagagtacaagcaaagggagaagcagagggagaagcagacatccgctaagcagggagcccaacacagggctctatgccaggaccccaggaccatggccagagccaaaggcagacacctagccaactgagccacccaggcaccccatgagtcagttttctaagccctgtgaatgtctgtgtcagtgcatggtgatggcgaggtgggtagagagaaagagaaaaaagggaagaatagagagagaatcataataataacccttcacagagatagtgaaggctccttgcatggagcttgcttctccctctgcctgtgtctgcctctctctctcatgaataaataaataaaatatttttttaaaaaaatataaccatcttaaaaaatttttattgatatattgataataatacaataatattagaggactttaacaccccgttcactgcactggacagatcatctaagcaaaaaatcaaccaggaaacaaggactttgaatgacacactagaccagacagacttcacatattttatcctacagtaaaagaatacacatttttgggcagccccggtggcgcagtggtttagtgccacttgcagcctagggcgtgatcctggagacccgggatcgagtcccacgtcgggctccctgcatggagcctgcttctccctctgcctgtgtctctgcctctgtgtgtgtgtgtgtgtgtctctatgaataaatatatatatacacacatatatatttaatatatgtatatatattatatatatacacattcttctatattctatatatagaatatatatattctatatataattatatatatatatatatatatatacacattcttccagagtgtgcatggaacattctgcagaatagatcatatattgggtcatgaatcaggtctcaactaataccaaaagattattccctgcatattttcagaccacaatgctttgaaactggaactcaatcacaaaaggaaatttgaaaggaacacaaacacttggaggttatagagcattctactaaagaatgaatgggtcaaccaggaaattaaagaagagtcttaaaaattaatggaaatggatgaaaatgaaatcacaactgttcaaagccttgagatacagcaaaggcagtcctaagaggaaagtatattgcaatacaagcctttctcaaaaattagaaaaatctcaaatactcaagctaaccatacatttaatctaaaggagctggagagggaacagcaaataaaacttaaacccagcagaagagaaataataaaaattagagtggaaatcaatgaagtagaaacaagaagaacagtaatacagatcaacgaaactagaagctggttcttggaaagaattaataaaatcaataaatccctagccagacttattacaaagaaaagaggaaggacctaaattaaaaccatgaatgaaagaggagagattgcgaccaacaccaaagaaatacaaacaattttaagaacatattatgagctgtaggaggggcacgatggcggaagaggagggtccccaagtcacccgtccccaccaaattacctagaaaaccttcaaatcatcctgaaaatctaaaaattcagcctgagatttaaagagagaccagctggaacgctacagtgagaagagttcgcgcttctatcaaggtaggaagacggggaaaaagaaataaaggaacaaaacgcctccaagggggaggggccccgcgaggagccgggctgaggccggggcgagtgaccccaggacaggagagccccgtcccggaggagcaggagctgcaccgaccttcccgggcggaaaggggcccacggggaggtggagcaggacccaggagggcggggatgccctcgggctcccggggacactaacagacacctgcgccccgggagagtgcgccgagctccctaagggctgcagcgcgcacgggggacccggagcagctcggggggcttgggggcggctccgcggagggggctgcggggcgggagcagctcggggggctcgggggcggctccgcggagggcgttgcgcggcccgggagcgcgaatcaacagcgctggccccggagcacaggacgccaggacacagcccaggatccggcctcccccgggacaggcagagtccgggagggtccatgacagcgaggacgctcctgccccgagctgagcagatcagcggccgccgcccaggagctcccaggccctgcagatggagagctccggagttactgggggagctgatccaggggctccagaactgggcgccgccactggggttgttcctcctggggcctcacggggtaaacaaaccccactgagccctgcacgaggcagggggcagagcagctcccccaagtgctaacacctgaaaatcagcacaataggcccctcccccagaagaccagctagacggacaagttccaggggaagtcaagggacttaaagtacacagaatcagaagatactcccccatgtgttttttttttttttctttttgatttctgattgcttcccccaccatttttttcctttctttctttttctttctctttttcttctctcttttcctttttttcttccttttttcttttttctttttctcttttctttccttctctctctctttttctccttttcccaatacaacttgtttttggccactctgcactgagcaaaatgactagaaggaaaacctcacctcaaaagaaagaatcagaaacagtcctctctcccacagagtttcaaaatctggattacaattcaatgtcagaaagccaattcagaagcactattatacagctactggtggctctagaaaaaagcataaaggactcaagagacttcatgactgcagaatttagatccaatcaggcagaaattaaaaatcaattgaatgagatgcaatccaaactagaagtcctaacgacgagggttaacaaggtggaagaacgagtgagtgacatagaagacaagttgatggcaaagaaggaaactgaggaaaaaagagacagacaattaaaagacgatgaagacagattaagggaaataaacgacagcctgaggaagaaaaacctacgtgtaattggggttcccgagggtgccgaaagcaacagagggccagaatatgtatttgaacaaatcctagctgaaaactttcctaatctgagaagggaaacaggcattcagatccaggaaatagagagatccccccctaaaatcaataaaaaccgttcaacacctcgacatttaatagtgaagcttgcaaattccaaagataaagagaagatccttaaagcagcaagagacaagaaatccctgacttttatggggaggaatattagggtaacagcagacctctccacagagacctggcaggccagaaagggctggcaggatatattcagggtcctaaatgagaagaacatgcaaccaagaatactttatccagcaaggctctcattcaaaatggaaggagagataaagagcttccaagacaggcagaaactgaaagaatatgtgacctccaaaccagctctgcaagaaattttaagggggactcttaaaatccccctttaagaagaacttcagtggaacaatccacaaaaacaaggactgaatagatatcaggatgacactaaactcatatctgtcaatagtaactctgaacatgaacgggcttaatgaccccatcaaaaggcacagggtttcagactggataaaaaagcaggacccatctatttgctgtctacaagagactcattttagacagaaggacacctacagcctgaaaataaaaggttggagaaccatttaccattcaaatggtcctcaaaagaaagcaggggtagccatccttatatgagataaactaaaatttaccccgaagactgtagtgagagatgaagagggacactatctcatacttaaaggatctatccaacaagaggacttaacaatcctcaatatatatgccccgaatgtgggagctgccaaatatttaagccaattaataaccaaaagtgaagaaatacttagataataatgcacttatacttggtgacttcaatctagctctttctaccctcgataggtcttctaagcacaacatctccaaagaaacgacagctttaaatgatacactggaccagatagatttcacagatatctacagaactttacatccaaactcaactgaatacacattcttctcaagtgcacatggaactttctccagaatagaccacatactgggtcacaaatcgggtctgaaccaataccaaaagattgggatcgtcccctgcatattctcagaccataatgccttgaaattagaactaaatcacaacaagaagtttggaaggacctcaaacacgtggaggtgaaggaccatcctgctaaaagatgaaagggtcaaccaggaaattaaggaagaattaaaaagattcatggaaactaatgagaatgaagatacaaccgttcaaaatctttgggatgcagcaaaagcagtcctaagggggaaatacagcgcaatacaagcatccatacaaaaactggaaagaactcaaatacaaaagctaaccttacacataaaggagctagagaaaaaacagcagatggaccctatgaccagcagaagaagagagttaattaaaattcgagcagaactcaatgaaatcgagaccagaagaactgtggaacagatcaacagaaccaggagttggttctttgaaagaattaataagatagataaaccattagccaacctgattaaaaagaagagagagaagactcaaattaataaaatcatgaatgagaaaggagagatcactaccgacaccaagaaattcaaacgattttaaaaacatattatgaacagctatacgccaataaattaggcaatctagaagaaatggacgcattcctggaaagccacaaactaccaaaactggaacaggaagaaatagaaaacctgaacaggcctataaccagggaggaaattgaagcagtcatcaaaaacctcccaagacacaagagtccagggccagatggcttcccaggggaattctatcaaacgtttaaagaagaaatcatacctattctactaaaactgtttggaaagatagaaagagatggaatacttccaaattcgttctatgaggccagcatcaccttaattccaaaaccaaagaccccaccaaaaaggagaattacagaccaatatcaccgaagaacatggatgcaaaaattctcaacaagatactagccaataggaccaacagcacattaagaaaattattcaccatgaccaagtaggatttatccccgggacacaaggctggttcaacactcgtaaaacaatcaatgtgattcatcatatcagcaagagaaaaaccaagaaccatatgatcccctcattagatgcagagaaagcatttgacaaaatacagcatccattcctgatcaaaactcttcagagtgtagggatagagggaactttcctcaacatcttaaaagccatctacaaaaagcccacagcaaatatcattctcaatggggaagcactgggagcctttcccctaagatcaggaacaagacggggatgtccactctcaccactgctgttcaacatagtattggaagtcctagcctgagcaatcagacaacaaaaagacattaaaggcattcaaattggcaaagaagaagtcaaactctccctcttcgccgatgacatgatactctacatagaaaacccaaaagcctccatgccaagattgctagaactcatacagcaatttggtagcgtagcaggatacaaaatcaatgcccaggaatcagtggcatttctatacactaacaatgagaccgaagaaagagaaattaaggagtcaatcccatttacaattgcacccaaaagcataagatacctaggaataaacctaaccaaagagggaaaggatctataccctaaaaactatagaacgcttctgaaagaaattgaggaagacacaaagagatggaaaaatattgcatgctcatggattggcagaattaatattgtgaaaatgtcaatgttacccaggcaatgtacacgtttaatgcaatccctatcaaaataccatggactttcttcagagagttagaacaaattattttaagatttgtgtggaatcagaaaagaccccgaatagccaggggaattttaaaaaaggaaaccatagctgggggcatcacaatgccagatttcaggttgtacttcaaagctgtggtcatcaagacagtgtggtactggcacaaaaacagacacatagatcaatggaacagaatagagagcccagaagtggaccctgaactttatggtcaactaatatttgataaaggaggaaagactatccattggaagaaagacagtctcttcaataaatggtgctgggaaaattggacatccacatgcagaagaatgaaactagaccactccctttcaccatacacaaagataaactcaaaatggatgaaagatctaaatgtgagacaagattccatcaaaatcctagaggagaacacaggcaacaccctttttgaactcggccatagtaacttcttgcaagatacatccacgaaggcaaaagaaacaaaagcaaaaatgaactattgggacttcatcaagataagaagcttttgcacagcaaaggatacagtcaacaaaactaaaagacaacctacagaatgggagaaggtatttgcaaatgacgtatcagataaagggctagtttccaagatctataaagaacttattaaactcaacaccaaagaaacaatccaatcatgaaatgggcaaaagacatgaagagacttctcacagaggaagacatagacatggccaacacgcacatgagaaaatgctctgcatcacttgccatcagggaaatacaaattaaaaccacaatgagataccacctcacaccagtgagaatggggaaaattaacaaggcaggaaaccacaaatgttggcgaggatgcggagaaaagggaaccctcttacactgttggtgggaatgtgaactggtgcagccactctggaaaactgtgtggaggttcctcaaagagttaaaaatagacctgccctacgacccagcaattgcactgttggggatttaccccaaagatacagatgcagtgaaacgccgggacacctgcaccccgatgtttatagcagcaatgtccacaatagccaaactgtggaaggagcctcggtgtccatcgaaagatgaatggataaagaagatgtggtttatgtatacaatggaatattactccgccattagaaatgacaaatacccaccatttgcttcaacatggatggaactggagggtattatgctgagttaagtaagtcaatcggagaaggacaaacattatatgttctcattcatttggggaatataaataatagtgaaagggaatataagggaagggagaagaaatgtgtgggaaatatcagaaagggagacagaacataaagactcctaactctgggaaatgaactagggttggtggaaggggaggagggctgggggcgggggtgaatgggtgacaggcactgagggggacacttgacaggatgagcactgggtgttattctgtatgttggtaaattgaacaccaataaaaaattaatttattaaaagaaagaaaattaaaaaaaagaaaaaaacatattatgagcaaataaatgccaacaaattaggcactctgaaagaaatggatgcattcctggaaaccaccaaaattgaaacaggaagaaatagaaaatctgaagagacatataaccagcaaggaaattgaaggagcaatgagaaacctcccaaaaagcaagagtccagggccagatggcttccccagggaattctaacaaacatttaaagaaataatacgtattgttaagatgctatttccaaaaatagaaatggaaggaaaacatccaaactcattctatgaggccagcattaccttgatcccataaccagacaaagatctcatgttcctgatgacatggttgccaaaacactcaagaagatactagccaataggatccaatagtacattaaaatgattattcaccaagagcgagtgaaatttattcctgggcttcaagggtggttcaacattcacaaatcaatgtatgatataccacattaataaaaggacaagaatcatatgatcctctcagctgatgtagaaaaagcatttgacaaagtacagcatcctttcttgattaaaactcttcaaagtgtagggatagagggaacatagtatcataaaagccatcactaaaagcccacagtgaatatcattctcaatgggggaaaacagagtttttcccctaaggtcaggaccatgacagggatgcccattctcactagtgttattcaacatagtactagaagtactagcctcagcaatcagacaacaaaaagaaataaaaattcaaatcagcagagaagtcaaactctcactctttgtagataacatgatactttacaaggaaaatccaaaagactctatcccaaaattgctagaattcatacagtaattcagcaatgtggcaggatataaaatcaatgcacaggaataagttgcattcctatacactgagactgaagaaagagaaattaaggaatcaatcctatttacaattgcactgaaaattcataatatacctaggaatatgcctaaccaaagaggtaaaggatctgtacactaaaaactatagaacacctatggaagaaattgaggaagatacaaagaaatggaaaaacattccatgctcatggattggaagaataaatattatttaaatgtctaagctaccaagatcaatctatacatttaatgcaacccctattaaaataccatcaacatttttcacagagctggaacaaatattcctaaaatttgtatggaaccaaaaaaaaaaccccaaatagccagaggaaggttaaaaagaaaaccaaaactggtggcatcgcaatgccagacttcaagctctattacaaagctgtgatcatcaagactgcatggtactagtgcacaaaaagacacagagatcaatggatcagaattagagaacccagaaatggaccctcaactctatggtcaactaatctttaataaagcagtaaaaagtatccagtgggaaaaagacagtctcttcaataaatggtgctgggaaaattggacagccacatgtagaagaatgaaactggaccactttcttacaccatacaaaaataaactcaaaatggatgaaagacctaaatgtgagacaggaatttttcagaatcctagaggagaatgcaggcagtaacctctttgctctcggttgcagtaacttcctgttagacacgtctccaaaagcaagggaaacgaaggcaaaaatgagctcttgggacttgatcaaaaaagcttctgcacagcaaaggaaacggtcaacaaaacttagaggcaacctacggaatgggagaagatatttgcaaatgacatatcagagaaatgactagtatccaaaatccacaaagaatttatcaaagtcaacacccaaaaaacaaataatctagtaaagaaatgggcagaggacatgaacatatatttctccaaagaagacatacaatgggcaacagacacatgaaaaaatgttccacatcacttgtcatcagggaaatacaaatcaaaaccagaatgagataccactttacaccagtcagaatggttaataggacaggaaacaacaaatgttggtcaagttgtagagaaaaggggaccttcttactactgctggtgggaatgcaagctggtgcagccactctggaaaacagcatgaaggttcctcaagaagttaaaaatagggatccctgggtggcgcagcggtttggcgcctgcctttggcccagggcgcgatcctggagacccgggatcgaatcccacatcgggctcccggtgcatagagcctgcttctccctctgcctatgtctctgcctctctctctctctgtgtgactatcatgaataaataaataaaatctttaaaaaaaaaaaaaaaaaaagaagttaaaaatagagctaccctatgacccagcaattacactactagggatttaccccaaagatacaaatgtagtgatccaatgggcacctgcaccccaatgttcatagcagcaatgtccacaatagccaaactgtggaaagagctgagaggttcatcaacatatgaatggataaaagagatgtggtgtatacacatgatggaatattactcagccatcacaaaggataaatacttaccattttacatcgacatggatggaaccggagcgaaataagtcaatcagagaaagacaatcatcatatggtttcactcatatgtggaatataagaaacagcacaggagtcacaggggaagggaagggaatctaccattcagggaaaactgaatgggtagtcattagagagggagaaaaatcatgagagactcccaactataggagacatactgagggttgctgaatgggaggtagctggggaatggggtaattggctgagaaggaggatgggtgatgtaatgagcactgagtattatacagaactgataaattcttgaacactatatatgaaactaatgatgtactctatgttggctaattgaatttaaattttaaaaaaagaatttggggtgccagaagcaaatttgtgatcttagtgagtaagaatacatttgggaatgaggaaccaaaagtctgggtctaatcagcttcttctttgatattactgctgacggtgtggatccacccaatgtattaatttgtgctttagtgtcagtatttctcctaggatggttttgtctatcacattatgctggaaaagtgaatgttggtggcattttgttttgcttatttgtttatttgaactcattattcttaggaaatatccactaaattataatattatgaactttaaaaaggctctgtgaaacaaactcaaccctattttgaggtgttttttttccaacttgtgctagattctgttgtaaacagaatattgtaaatatttttaagaatttttgtatcaatattaataagtaaattcatttaggttttttgttctctcggttttttttttttaagattttatctatttatttgagagagagagagtgcacaagagagcatgagctgggggagaggcagacggagagagagagagaggcagactctgctgaacagggagctcaaggtagggctcaatctcaggacccagggaccatgaccctagctgatgacagctgtttagccaactgagccacccaggtgtctctcatttatagtttttatttttgtgcactgtcatagtttaacattgatattatacttacttcactaaaagaatactgttggaattactgctcttgaaccatttatttaggattagaattctctctctttttttcctttaaagtctttattgcattgccctaaatatctgtacctggagcttttactggggtagctcttttacaatttttcctgtttcttcgttggaaatattctatacaaatagtctacctcttttttttttaaagattttattgatttattcatgagagacacagagagagaggcagagacataggtagtgagaaagaagcaggctccccccagggagcccaatgtgggacttgatcccatatcccaggatcatgccttgagccataggcagacactcaaccactgagccacccaggcgtcccacaaatagtctacctctacagggattggttttggtaaacttttcaagacaattcatttaatccaaattttcaagtgtatttttataaaattgaacaaagtaatctataattttcccctgttcatgtattaattttgtccttgtcattttttattttctctactttttcttgattaggtttgtcagtggtttattttactgaaatttcttaaagcttttgaatttattctatttttccattttctaactctttaatttctgcttttatttttatgacctgtgattcattgtattgttcttttcacttaatcttggtttcattctttcctttaatcaatttaagcaattaagtccatgaattctctgctgagtactgccttagctatatcccatgacttttgatatatgatttttaattataattcttctagaaatttttcatgtttgtttttctctctgatcaagaaagacacagtttctttaagtttctatgtggagaagtatttctctttcctgatttttttttattgttatctggcttgttccattatggtcagagaatagtatttatatcatttctacttttaggaacttactggggctctttgtaccatagtatgtagtccattttcattaatgttttgctggaatttgaaaagatgtattctctacttttaatgaagaagtctttttttttttttttgttcatgatagtcacacagagagagagaggcagagacacaggcagagggagaagcaggctccatgcaccgggagcccgacgtgggattcgattccgggtctccaggatcgcgccctgggctaaaggcaggcgccaaaccgctgcgccacccagggatcctgaagaagtcttaatatagatccatgagatctaattttatactgttggaatatcttctgtgatcatacttatttttgttcactgagaaaagcaaattaaagtcacctaatattagtacatttctgaatgttttccttgtatctcccttaatttcaggttaatgagagttacttatgtgctgtctgaacttaaatgcacatctcttatgctcttatatactcattatgaattttacattttacattaaaaagtgccttcttgtctcactcaattttttccgtttgaatttcgcctgttataacaatggtgttgttacctctgtttctttcttgtttgcattcttttgttatgcctttcccatgattttattttttgaataaacaaatgaaactttctgagtcactcttaggtgtgttttttgtatattacaaacagtagtttttctttcaatctaatctaaaatgatttttattttatatatcagttaagcccatttgcaattttagcaaagaaattcagtgtaatttgtgatttgtaagtgatactattttctgttaaatataccatttatatgagttttttttttttttagaaaatctttcattgtgcctcgtgttttctaaattgcagtttttcagatattttaaaaggtgtatattttgggattgtcctgataattttattcttcatttagtttcctctttctttagtttctgttagttatgaacatgataaaattgacagcttaaatcctctccttttccatttttttgtgtttacctttgtactcttaatgtgttctaaatgctaatacttggcttatccattttgtgagataattttagactcccggataattatagacaaagtcaccaataggtttatcctacatccttactcatttttccatttaatctgtaattattgagaaataagtttctgtttgtcaatttcttcttataattccatctatattttcctacctattttgtatgtatattttgtgctattttttgctacgtgtaaactgatctgttttaatataatgttctagtaacttcttaacattattcaatgatcatctttctactaattcttttgatgttagactacatttctaggtatcaaagtaactacaaacattgtcttcggttggtgttgattgtttatatcttattgcatgttttgattttaaccttttcctgtctttaggttttctttgtgattaatgggaagtgtgtaactggactttgtgatccccttactgactgcttcaccttcagtgatacatggttattgccacccacaagtcaatgatcctcctcctgacatcagaaggtcagaaggtcagtagtctaatgctaggtcaccatgctcacatcatttgcctcacttcatctcatcacatagtcattttatcatctcacatcatcataagaagggtgagcacagtagatgagatattttgagagacagaagcaatatataacctttattacagtatattgttatatttgttctcttttatttttagttactgttgttaatctcttattgtgcctaatttttaaattaaacattatcataggtgtgtccataaaggggaaagcaaagtatacatagggttcagttactatctgtggtttcaggcatccattgggaggtcttggaacatattccccacagataagagcaggacaactgtattggtaatccaatctgaaaacctcttttaacttcaaatttaatctatttattgggattactaaattttctggatttgcttctactaatactgtgttttctattttgttatgctctttctttgcttcctttttttctccatcacatattaaattgattacatttttaagtattctctattttcctcttacaggcatagtaattttaaattttaattatattagttaagagttacccctacatttaaaacttttttaaatttaaattccatttaattaacatatactgcattattagtttcagaggtagaatttagtgattcaccagttgcatataacactcagcactcatcatatcaagtggcctccttactacccatcacccaattacctcatccccccacccatctccctccagtgaccctcagttcatctcctatagttaagactcttatgacttgcctccctctctgttttcattctattttatttttcccttctttctcctatgatcctgttttgtttcttaaattccacatgagtgaaatcctgttgtatttgtctttctctgactgacttatttcgcttagcataataccatctagttgcatccatgtcgttgcagatggcaagattttgttcttttgatggctgagtagtattccattatatatatgccacctcttctttatccattcatctgtcaatggatatctgggctctttgcatagtttggctgttgtggacattgctgctataaacattcgggtgcaagtacccctttggatcactatgtttgtgtcctttgggtaaatccctagtaatgcaattgctgggtcatagggtagctttatttttactcctgcatttttaacgtcactgcctaaattagcaatatccgaagttaaactctaccctccttccaaataaggcaaagacttaatttttttttaagattttatttatttactcatgagagagagagagaaaggcagagacacaggcagagggagaagcaggctccatgcagggagcccaacatgggactcgatcccgggtctccaggatcatatccctgggctgaaggcggcacttaaaccgctgagccacctgggctgcccaagacaaagactttagaatgttttactttatctgcctcattctcatgctgtgatcattccatcatgtccttaaatttaatagtcataattgttggtgatttttatagacatttttcattcctcatgcatattttaggcagatgagttgttgttgctgttgctttgtatatgtgtgtgtttctcatctttgcttcctgtgtcccaatttttcttgctgaatttagtatccttatgtatgtggtaataaaagaaaaacaaatgacaactatcatatgatgtcactttctttccgtaagattgacaaaatctaaaaagttaacactctgtgttggtgagaatatggggaaacagataaacttatattgctggtggaactgtgcatgaatataacctcagtaaaagcaatttttcaacatatatcaatattagtaatgtatatacacttggactcagcaactccccctttaaaatttgatcctatggatattcttgcacatgtgtattataatgtctatagaaggcattgcttatattagctaaggacatccaaccgcccaactacccatcaataggagaagacaagctaaatgaaatatgatacttccataaaatagaatactatatagccatatatttctgagtgtaaaaaataaagttcagaacagtggatctaaggacttgctctttgtaaaaatagggaacaagagcatatatacatatttgcttaaatatacatgaaatttccctagaaggataaacacaaggcttacgcatgagttgtgtatacaaggggtcttggtaaaccacgagaaggatgggagtgagggtttcctctgcatacctttttgtggcttttggattttaaatcgcattagtgtattgcttatttacataaatgatatcttttaaaaagagaatagtaggagagtaagcagatagagggagtataggtaactcttttgaggagttttgtggtaaagctgggcagagtccatcttttccaagctttgtgacccaggcaagttagtaaaagtgcctaaatctccattttctcattctcagaactaatacagtaatatctgccacttaggattatcttaaagtaggaagatatatgtcaggcacttagcatagtacctgaatgattattgtcattaaagttattacaattcataagtacataaaactctagtttcaaaacctactatttgctaggatcattagatggacaccagactcaatcagatgggtgcttttattgctcacttggcaccaaaaactgggaagatctttgttttcctcactccctacttctccaagattctgacaactgtactcttcctcctcttgaatcacaactaccatgtggactacaagtggctatccgactcagctagggcataacggacttggaattcaacactatttccacatggggcaaagtagatggggtgggaggtcatctgggagttccaaagaaatccatgagactttcctaaggtttcccctctccattcatatcttcctttggaatgaataaaatatgacctaatgggaaagatgacaaaggtacataaggaggagaagttaagtggtggacagatgaaatggtgttagatggtaggcagggtgattactattatctgtggttacaggaccagagcacacttgttggtatttgcctaagttccacactttgacctccagggaacattttcagaatgtatccctgatataggacatacttaggaatttccctgaggtaaccaactttccagaccttaaggtcctgagatttgccacatctttctgaactgccccactggatgtctgggttttcttcccagctcgatcactgagtagccatgcgatttcagtccagtttctctttttgtaaagtaagatttgactgctatgttacttttaagatgccttctgggcttaaagtattaggagtctatgggtgtcattatactgaggatatcaaagaattttaacagaccatcttccatgagggcaacagtttccattaggttgggagatacaggaattattattcccatcatatacatagaggaaggacgtttggttgaggggggaaggaattaggccagatttctctctctccaaatgggtgaggggatgggataagtaggtgatagacatgaaggagggcacatgatgggatgagcactgagtgttatataagattaatgaatcactgacctctacctctgaacctaataatatattatatgttaattaattgaatttaaagtaaaaaaaaaaatgaaggaaaagaaaaaagtgggtatttcacggtaggtgatattcaagacacaaaaagcagactgaagcaaaggttgatctgcataagaagctccctactctgaccccaccctattcccaagggttgccaagcaggaaaaaaaaaaaaagcaaaacagcagaagttctggctagttcgtttgagaactggaaagtacctgctgtctctgggaatgtgaaactttctctttcctagaataggaaccttcaaaggtaagtccctcccaaaaggcagtaatgaacacagccttgaatcttcagtggttggcatgtgaagggaggactgaaaagctttactaatttgtgtggtctactatgaatcgagccctgtgccaggtagttgatataaagcttaataagatatatggccttcctcccaggagctcatggtctagtgaaagaacggaggggtgggaagacaaagagtttaatccttgaaagaggtaaaccccggagtgatagaagagcctggagaggacactttctccagactgagatcaggaaaggcttccttgaagacctgaccccctgagttcagtcttgaaggacttggggtaaatcggaaagggtggttcaagaaatggcaagcgcacaccataggcaaaggcacaaagacatgaggagggcagggaatttaccacagctggagcttaatgcaacagaaagggtgctgcaagtgagctgcacaacctcgtatgctctgaggaagatgtgagcagaaaggaatgaagaacacttgaaggatgttacagaagtgacgttgccctatgtgtctgctagaaagaaaaatgacttcacaaagaatggccagaagaggtgaaccaatggaggggaaggctctttggagatgagattgtctaagactaaatgaaagttataataacaacagaactagagagaaagcagtgatttcagagctatttgcctgatctgattatggattcgagactatgaacacatgatacaacataatttattggttaagattgtggactcaggggtcaggcctagattcaactccaactccaccactgtgtaaccttgggaagttatttaatctctttgagactcagtttccttgtctgtaagatgagataaccaatctcacagggttgaggaaaaggactaaaatgtctgaaaagcattcagcatagttcctattcacatgaaaactctatagacagatgttattaatgttttattaacactattaattaggaacctgctctacccctccataccttagcctcctccaaaatatcagacatcagtgtgaatggggaaagacacagaaaggcaacctcacaaatatttatgtcacaatggctaatatctatctcaaagaacacataagacacaagatagctggcaaaatagtagctatagcgacctctgggaaatgaaacaagggttagttttacttttcttgatgaatacgtgctatttacataataaggaaaatatttttaaatagatgtatcatgccacaatacactatgcagcaccagggaaatgaggctcttggacacagaaagcaccaccacctctccccacctcgactgccagccgtggtaggagcacacgtggtccaaacttccatcatgccccaagctccaggagcaactatccaggggcacaagcccagggaaactcggagcacaagctcctctggatcatgcagatggccaggagaaaggccctagagccctggggcctcagtcctccagtagctgctgcaccaggcgggaatagaggtcttgcccctccaagatctgtgcatgctctagcagctctccctccctgagcaccaggatctggtcagcactctgcacagtctccagcctgtgagtgatcaccagcaccgttcggtccccatgagatttccaatcctgcagctgaagagggaggatcataatacctcagagagataggaacaggggcacctgggtggctcagttgggtaagcatctgcctttggctcaggtcatgatcccggagtcctgggatcaagccccagctccctgctcagcagggaatctgcttctccgtctccctctgtgctcaccctgcttgtgttctccctctcactcttgctctctcaagtaaataaataaaatcttaaaaaaaaagaaagaaaagaaaggtaagaacaggatgggcaccatatcccaattgggcaccatctcttgtagcatcaggtaaaggaggtgtgaaagatgaaagtcaggaagagtagatgatagagtctaccctgcacttctctatcagctgtccaactgcaggaggcaggtagtaaaggaagctgtggaagaagggtgtttccacaccccatgtcctccattccactccctgccccccggggaagcacagatacccctccaccagtgattaccctccaccagtgagccgttcatcttctctctgcccagttctgtgtaggctgatccttcaggggtgctcctcaggcgcccactgcccccaccctcccacaccagtactcacggcgggctcacactggacatccagggcactggtggcttcatccaggatgaggactcgtgggtcccgcacgagggcccgggcaatggccaggcattgtttctgtcccacagccaactggttccctttctcccctacatctgagaaaaccgagaaatacctttcctcagacacaagtggcctcgacaacatcctccccaggagcagggacaagtgcacaccagcagttccactagcacccatcaggagtgctcacaagagagcaggggcagggaggacagggcctgctaggctgccctcagagagggaacactactaccaatggctgtgacgctgtcaggaacaaaccagatgggcaacttgagaacttctggtgctggagaaggtggggaagtcggagccaaacatcgggcaaggaaacagcagatagagtcacagggacacaacccgcgcccccacaaagcagctccaggtcctccactgactgaagttacctgtatatagtccatgttccatctcctgtatgaagctggatgcgttggcagcctgggcagctgccagcaccttctcatcactgcagctctgcagcccgtaggcaatgttgtctctcacagaacctgagaacagcacaggctcctgcccgactgaagccacctgtgcagaggagatgggagcatgggactgcgcatcaacccccgtggcagggatccccttctcctcttggcctacctctctcagagtggactccctgggtttcttcccactgacccccccttcccatgctctctgcacacgcttcttccctcctctcttctatccctcctcctcctctatgaccacccacctgtcggtgcaggtagccatgctcatactgccagaggggcttcccatccagcagcagctgccccttggtgggctggtacagattctgcagcagggcagccacggtgctcttcccagacccattgggccccaccagcaccgtcatctggccaggacgaagggtgaaggtcagcccctggaaaggccaggaaagggttagaggcttacctcagttccctacccttctctctctgtcaaaggtaagatcaacttctcagaggccttgctgcctgagagccacgggtccacattccctccttgtggcccctttcaggcaccttgaggacagactggtcagggcagttgggatatgcaaaggagacatcctgaaattccaccaggccctgcagagtgggaggggccagcgtccccggaggatgcaggtttggctttcgttccaagtactgaaacaccttctcagcagcccctatgttgctgagcatatccccacacatgtacaccagggtctggaaaagagaattgaaggagtcagctaatcaaatgttgcttcaccagaaaccaactccccagctttcacacactcccaggccacactctgcccaagccaggcttctccttccctcatccaaaaaggattgcctactttaaatgtgcaattggttttttttgtttttttttttttttatgatagtcacagagagagagagagagaggcagagacataggcagagggagaagcaggctccatgcaccgggagcccgacgtgggattcgatcccgggtctccaggatcgcgccctgggccaaaggcaggcgccaaacccctgcgccacccagggatcccttaaatgtgcaatttggatggaatgtaaaggcaactcaataccccagtgtgccaatttgcaacacaaaggatagagaggtccatactcctgttcagcgctccttctatccccagaccttccaattactgttctgtattacttgtgcacagtaagttctgttttgcctaactagacagggagctccttaaaaccaggcactgtgggcagccccggtggtttagcggtttagcactgccttctgctccaggggtgatcctggacaccagggatcgagtcccacatcgggctccctgcatggagcctgcttctccctctgcctgtgtctctacctctctctctctgtttctgtgtctctaataaataaataaaatcttaaaaaaaaaaaacaaaaacaggcactgtgcccaccttatctttgcagccaacagagtacctagcacagttctccatacataaaagacatctcacaaatatctaggaaaattataaaataaagaccgagatgaagtaactatttttgaaatctggtaaatatagggaaaaaactaaatgctattccacctttcctactcagactgtaccactggtttaccaaagagtggatgaagagaagtctcctttcctggatagatgtattccagtgaataaatggaggaatggtaaagtgtcactgtcttgcaacccctaataatggatctaggcaatgaacattgatggctgatgctaccacagacatacatgagagagataaagtgtaatatatgcagtgcataactgtatacatatgttacatgtatcagacaagtggaaatataaacactgtatttgataaattttaggaattactgttttgaacttttttggtgtgataagggcttcatggctatattttttaaatgtttatgttttagagacatgtatgtaccgaggcttttatagataaaactgtatcttgaatttgcttcaaaataatatgggtaggggtacagttgaaatagattggccatgagttgataattttaaagcaggtgatgggtacatgcaggctcattataggttttctggtctttttgcatatgtttgaagttctccataacacaatcagttgggattttgtttcatttgtattatatttttaaggggagcaaataaagctcaaggctcaccagagagaaaaatgggggaaaaaagagtatgcccaggctcctgactcacctgcacataatggcccaagtcctcctggtagagcagaaaggagagcagcccaccttgggtgaggtccccagcctggatctgctgccgtccacaattcagcatcaacacgtgcatgcccaagtgcagcatctggagggcaaaaagaaaggcactgaaagagtctgcattctttgccttctccactcctaccacactgagcagcagggtccccaggacgccctgaagtttcccatcgctccccctgccccacactgggtcctcctgccagccaccagcctctcaccctctgaaagagtaagtagagggcacgttccaggtctcgttgccaccgcagctgccggcatcgctccaccgccttcttatacagacagacctcgtgctcttcggccccaaaactgcgcacagtctgcagccctccaactgcctcctgcaccacctgtcctgcttttgccacagcattctggatctcccgaagcactgcctgcaaaagcaggccaggggatgcaaggggctgatgtagcagaagacaggagacccccatgtctcatccctgccctggggatgctccactcattgacctaaaaatatcaaactgtcctctttcctccttcctcacatttctttccagaaagactaatgagaagagagggaggaaagaaaatatgatgagttctcagtgctggatagggcaggggatacaggctttttctgctccttcgtttaaggtaattcacaccaccctcactgtctgaacgaagaaagaagggataattttcctaaggagccacagctagctaactgggacagggacaaggtgggaatgacactcaaaatggatcaaaaacctaaaccagagctaagactcttagaggaaaacatcagggcaaagcttcatgacactagatttggtgatgatttcttggatatgaacccaaagcacaagcaacaaagagggaaaaaaaaacagataaattggtcttcgttaagattaaagaagatttgtgtatcaaaggactctatcaacagaaaaggaaacccacagaataggagacaaaatttccaaatcaggtatctaataaggagctaatatccagaatactgaaagaagtcctacaactcaacaaataaaacacaacccaatttttaaaaaatgagcaaagaacttaaacagacatttctccaaaaaagatacaaaagtggccaacaagcacaggaaaagatgttgaacgttagggaaatgcaaatcaaaaccatggtggaaataaaaatcacctcaaaaatataagaatcgctattattctttaaaaagcagtgcataaatgtatacaacagaatttcactcagccataaaaaagaaggaaatcctgccacttacaacaacacggatagactctgagggcattacactaagtgaaataagccagacagaaagacaaatactgtatgatctcatttatatgtgccatctgaagaaaaaaaaatcatagaaaaagagatcagatttgtagttaccagagaccagaggcaggggtaggggattgattggaggaaggtggtcaaaaagtacaaacctccagtcttaagtaattacaggggaatgtaagaaagaagaaacaaacagaagataacaagtattggagaaggatgtgaagaaactgaaacccttgtgtattgccagtgggaatggaaaatggtgcaggcactgtgaaaactagtacactggcggctcttcaaaatattaaaaatagaattacagtcagatccagcaattctacttctgggtatctatccaaaagaactgaaagcagagactcaagcagatatttatacaccacgttcacggtagaattattcacaagagccaaaaggtggcagcaacccaagcgtccagaaacagaagaatggataaacaaaatgtggtctatacctccatggaatattagccttaaaaacgaagaaaattctgatacatgctacaacatggatgaacctggaggacattataccaaagtaataagccaatcgcaaaaagacaaatactatacagggatccccgaacatccccacatacctgatggcggacattgtacaccttttcagcagttattgccagaggcaccttgagcagagagaggagggcaagtcgaggtgacaggctcagcatgaagccatacaaccccaccactttgaccagacttctcaagagcacattggcattaagaggaagccagcagctcatcaatttggtatctgagctcagtcttgaattcagctcccctgtagaggacagtgccagtgaggaaaccaggtataatgcagaaccccagggactccccgtcacaaccttccccattgacagagcctccacttccaaacacccccctcacttgcagagaccagtggaggccacctcactcccctgtcccaaaagagagcacagaagctccttgccctggcaccatgggtacaggtgggaagagaggctgtttatgggtggaggtaactaaaggacaagaactgtccaggggaatcctagacctggactccaggccccacctgtcttagtctcctggaagaaaccaaggtcctggcgcagaagggaggagaaaagctgctcccggacccgcacattggttctggacatgatgaaagtgaagcagctccctcggcagccagcacacagtgagctgtggaggaagaaggagatgggggaagaaggggacacaggtgcagagaaggagagaataagcgagagaagcagaggagaaagcacagaatgaaaagaaatataaggttggagaaagtgtaccatgagaggcagaagagaagcagagagagagggagacaaggggaggggcaggaataaacagagggaggagaaacaggccagggagagctggatgtgggaacaaaatcatgacatgtacaaattcacgagtttttatggagctcactccatgctagacatagggaagactataatagaaattaagagatgttatcaagagaaacaacctatggctggcttccatctggtctcttcagattgtccctccagtctttcccctctgtcttggtgtctttccttcccaccccaaagtccttcttcctactttattgtaggaattgcagcaatgaattcccttggccaccccttctctggagccccagagacatgctattccctcatctctaccgtccctggagctgaggatttctcttagaccaaccatttttacagcaaaacttaaaggaaaaatgtgaaagcagagaagcaagtatttcacaaatatggtttctatgtttagaaggctgttggcacagtcagacataaaatgaggagggtttgaactccggcaatcacagagagaatggccagaaaagagccgcaagagaaataccttgaaagcagaaaccattggggctagtgtctaaacatcagaatggcatcaacatgggtgttatactatatgttggcaaactgaatttaaataaaagaaagaaaatgaaagaaaaaaaaaaaaagaaagaaaggcatcaacaatactgatgcttggagcctaggaaactgattgtttccttcgtgggaataaaagacggggccactttcaagaagaccagaagggagtattaatacatttgaagctctgggtatgtgcggtgtaagttaagagtgggttttatccaatgagaatgtcaaggaggcaactggattacaggattggagctgggtgtagaaatatggatctgcagagaaaatcaaagaactgagtcatgaggaaaggctgtatttaagggtccagagaaggagaataagttttgcaggggcggtagattggattggcaagtagaaagggagtccataaaaactaaatgaagaaagggatcaataataataagaggctattctaaggccgaatgctacaaagaagcaaagagaactgaggactgaattaaaaaaaaaaaaaaaaaaaaggcagtgaattgatcaatgggaagtacacttttgagtaactgctttcagcaaacagcaaatatggattggaagcatgatttggtaaatacagggattgaaagaatgaatggatgagtgtgtgaaatagaatggtgaataaacaattcacacgtattttaagtattttatgcttggtgtacaaaaaggatctgaaaacagagctaggaaacggacagccctgtaaagatgaggcgctagcaaatgggtccagctgagcatcacctaccttccaatggagaagaggcacatgaaaaagatggcggtggcaaaggcgtcagggttgaaatcacctctcaggatatcaatgacacgaccagaatagtaagggatgaccgtctcacctgagagaggtatggaggagaacagatgaccgtgctggcaccaagggcccttgcccacctccggtccccagtgccctcttcctgactcacccaacacagcgacaacaaggaagaagaaggctgcgacgaggtaaggcaggtctggccaggagagcctcagcagcctccacatcaagtctgtgttcttctcctggccctgctccccctcccgggcttccggggagctcagcagagcccacattgcccagctcagccacgcagccccgtaccccaccagccgcccgctccagggggctgcagccactccgactaggggggcgctcaggagccctgggaccagggccctcagggagaggaacagcggagtctccaggcagagcgggggcagcagcgctcccacctgccccagcagtcctcccacttttagcagccaccagagccccccaagccgcagggtcccctccagccacaggcctggaagcccccggggaaggcgagcgcccagggtcccctgaagcagccagagcagagcccagtcagccagcagcaggaaggcccagggtctcaggtcagggaaccgcatggtgttatctaggggaagaagatgagcaattacagagctggggtccccatctttgcccttatgctcaccaccccgactaggcccagcctgtccctcggctcctcattttacccagtcgtaccccaaaaggtccgcctgcgtccccggggcccatcagtacgtcccgcttatgacagaaggcacccggcctacggagggagcctcgtcccgcatcaaattcccgtgaccccctccccgcacgcccctgccccgcccgccgccgccgccgccgccgccgcgttccgaggagccgcctgcgctccccgcccggcggctggcgctgcccgggggcccggagagggggccgtgggggcgcccagcggatgcgtgggtccgcgctcgcggcttccggccgcaccgacccacccgcggcttcgggacggcagctccggagcgctctccgctacgtgccgagcaccgggctctgcaacgcgctcgccgggctcaccttcgtccccgccggcgacactcggcaaactggggcgccccgcacccaacactttcactttcgcttccccagccggggccccggttcccagcagggcgaccagcgggggacgcgcgacacctgccggtcgccgaagcccagtgcggagcccgcgctcgctcgccacgccgggccgggccgggccgggccgcgagcctccggcgcttagcaacagttactccggaacagaaagctcctgcaagggttttaaattgttattaagtgaaataaagctatttcagggattgcaatgttttgtgattggaggacaactgggttgtcttgcctcaagctctgattctcaagctcttactgcctcaggctctgatcctgtgttgagaactgcctcttcctccatccaggcgccagtgttagggtctgggatcaaaacagagccagattctgagcgagaaacactcagatctctcctagatatagggttccagacacgttcaccagggcctaagtgggtttccacttgcacagattttgagctgaaaggccctgattctttttatcttcatctgctctcctcaatacggcaccttgagcagagcacgtgttcagaatgcctctaggtcgtttcaaattatgttctcggagcacctctgtcatatgaggagaatggactttgtttcctggtctattgtacattaagccctaaacaggattctatagttcctgcctgacccacagcccatctatggaacatgctggtttgtttatcccagaaatagctcttcagattgaaactacctccccaaaataaaatctttaaaaaggtggagtgtggtacctgggtggctcagtggttgagtatctgcctttggctcaggttctgatctcagggtcccaaaatcaagtcccacatcaggctctctgcagggagcctgcttctccctctgcctatatctctgcctctctgtgtgtgtctcttatgaataaataaataaaacctgaagggaagaagaaagaaaagaaagaaagaaagaaaagaaaagaaagaaagaaagaaagaaagaaagaaagaaagaaagaaagaaagaagaaagaaagaaagaaaagaaaagaaaagaaaagaaaagaaaagaaaagaaaagaaaagaaaagaaaagaaaagaaagaaaaaagaaatttgcctctccaactcaaaatatccccaaaggaaggatcacttgaattccaaaccacccttttgaaatgttactagtatgtttaccagtgagttccttctagtttaaaggcaggggtggaggggtatttgaagtagaggattattaaaatttctccaaccttgccattctgggattttaagaatctcttcaaaatggggggtggggtgggggtaggaagcaagctctgtattcagctgctaactactttcaagttttttctttgcctcactctccctaagaggtgacattgtctgtgctccttgcagctccagcatgattcagaaaacctcattatgtctgtctcattttcctaacctgcttacttttccctcatatctccctcctcggggaggcagtcctcttcctcttcaatcatggtcttgtcatcttgcaattgagcatgacacatcatgaaattgaacccctaatgtccaactttgcattcaatatccagtgtccccaaactattatttgaagtaaatgtatcatgcttacaatcaccatagacatgtgaaatagaagctttttcagtggactccacaaactcaaagacagttggtctagcactctactcccagacacccaaaccattaataatggaccacacaggagtcttcaggttgtgtccctataaggagaaccctgacctaaattaaatggcacgtatgtgtccacagatcttgactgaccttcctgagggcatggagaaatgagctcggaaggaaaacccaagagaaatatttggtgaggccccatttcgtaggttggggttcaagtctcttctcagggaaagcctttctatctcccatccccttcccacaatcccagccccaaccccactcacccaagacacaaatgaatttataaccattttcctttattctacttagtggggcacccagagggtggggtaggggggagctacctgaaacaagagaacacacaagaaggtaaactctatcctacccccactggcccctggttctttccctcagggctcagattaggcttccctttgctctggggtataagccaacccaagcccctgagttgaccaggttttgccagaaaaggcatgcccagccacccctgttactgattggcctcttggtattggtgcagtagttcattgacatctgtactttccactttcacccaaccatcttccttcatgtggtacactgtaggcaaatgagaatgaacatggagtcacctttcacttcaagttcctgtcaatgatgttatgtggaagatgacaacatcataggcccaaacataccctcaacacatactttattactgacacttcaatgcccctctttggatgccaaaaacctcctcctcatgcctgagtggttcagtccgttaagcatctgactcttggttttggctcaggtcatgatatcagggttgtgagttcgagcccctcatcaggctctgccctcagcgtgggttcaacttgaagattctcaccctctgccctccccgcccaccactctcacacatgtgctctctctctctctctctctaaaataaataaataaatctttaaaaagattttctttctttctttcttctttctttctttctttctttctttctttctttctttctttctttctttcctttttaaagatttatttatttatctctaccactctgcctcctctaactctcccaatctcaaatcccccttccccacccaggagggtggtagcattggtttcttactgttgataataccgccagaatagctgtctcggtgggtggcataagtaatagccctgcggcccagttcataggcctcttcagggctgagactgggctgatagccactatccatgaccccataggcataagtgctcccactgccagtggagaacatatttcctgagagccgagtcccattttgatccacatagtagagtccaggaccctataggaagcaagaagtttccaagttggagtagaaagggagtttttagtaacttacaggttcaagtgtgagccataaaaagtggataaaagaataagaactacccaggaacatttgaactaggagagcactttagtaacaaccatagaactttagggggaaaaagttggaatcagctatttcaaaaaaaggaacaagcttacaaaacaatggtccatatctggacccagaaatagtccatggatatgctggaacaattctatgacccagtgttctatgtgccacccatcctttaagcgaggggatggaagtgtatcatggggaatctggtccctcatcagttgagggggaatatgaagaatggagagcacgtaccttcttatcccagccacagatcatactgcccatggagaggtccatgccccggtactggtacaccatgttggagagcagtttggaggctgctgacactgagatacgctccccgttccgcaggtagtacagcctgggtacaacagggtggtgggggcagcagattcagaggtggcaggagaaggctagctgtctgagcagcccacttgatgtgcaggaaataattaaagagacaagcatttaagaagaatggttttgggatcagggagagatctggaatttaaagaatctaaaccacataaagaaatcctagtaaatgacactgtcccaccagggttgatgatgtcagtgctaaataactgataaattatctggcttattggcaagagtaagctgagatctgggacaaggtttttaatcaccaaaaggctcttttgtgaaatgctacattagtaccaaaatgctacattagcacaggggcgaaaggatgagcagcagtgatctggaggttccaggatccaggactgaccactgggcttaggagagcaataagaggcctggcctacctgcactctttggccagcagacgctcccagtactgacagtctgcagcacagccagacatggtgccaagcagggaagggttaatctcaatcaccttgttaacccttgaggagcctgcaagaagatggagttttgagagaggtagattgacccccacagctctccctgtgtgtccaaaatcagtatcttcttctgctttggtgtagatgttgggttcctgctgagaggcgccccagctccccatattctaccggggggaacacacacactcactaatataattcccagcagtagcccgagaatccaccgccacaatcactccatgctggaacttgaaggccagtgtggtggtgccatggaccatctccttccgaatgttcttttctccattctcaccaagggactggaagaattcagtgggctaatgagagagaaaaagcagagaaatgggcactgcaaacttctgaaacacagggctctaagaaaggataaggatttactaggatttgggagtgagaagataggcagaaattctccaaccattaacaaccggaagagttaataacccatctctacaaggatgtgacttgggaaaaggaaaagaagcagcaggtgacgccagccttttccatcttccaactcaatggataagaaaggaaataaatgttaaccataactaaacattttaaggccgactttaatgctttttttttttccattcataggtcatttaaccctcacaacacgtcttattaataatatccccccattttacggaagcgacgccccagacctaaatgaagtgattgagccaagacacacaacgttgagtggctgagagaggccaacagtcaaagttccccggtccgaggcactccacagcccctagagcaaaggaaagccccaggagaaaggcttggcgattctggtctccctctggtctccctccaccacacctccaactctttgtcctaatcttttctaaccctcaagcggtcagccccaattcccacgtggcctcctccctggcaccgggttctggaaggttctccttcactaaaggatgccccctcccctgggttcccggcgtctgggtggtctcaagggcgaccctccactcctctgcgccctcctccccgcctgctaacacacacacacgccccttccccgccccggtttgcttcggagccccgacctgcattccccgggggacggcgagctccggagctcggagggagaaactgtagtgtccggggtccgagcgcagctggcttcccaaggcggggacagcgcaagccttccgcagccctcggggggctccgcacacctccagcagcgccattgtcgccgaaggcccagaaatcgtcggagaaggaagcgaaagcgaaagccccgcagccctaaggggagggaaccagaatttcttccacatccccctgccctttccaagaagaggccagtgggcggctggagaccaggggtatcatactgggaacaggcttctctctccgcccttacggaggtcggggagcaaagcgtgatagactgtcagaagaagaggagacggggagcgagcggctcgagagccgccttggcgcggagatcccggtgggcacaccagcacgccaccgggtgacccctggagcggctacgacgtggggtggggctgttaccgccccagcgcttagttagcctggaccagaaagctgcgagtcagcaagaagctgggggcactttcacctccggggcttggggcgttcgtaggaccatcattttataaaagtcggggaaagaggagtaggtgggggcagtgagtcttgagggcaggttctggggcaaccggcagcagaatatactcgcaatgtggggaaggcggcaccagggcgaggacgcagtctctgaatctttggacttggtccttcagggcctctcctcgtccaacgggctccctaacctatggccacccgcaagaaccgccctccgtgcgcgcacctcctcgcaggactctcgctcctctgagcgccaccgaggaactcctctaaacgccgcccctccttgcaacccggctgggcctaacctacccggcaactgttgacgtcacacaccgaggccctcccagaatggacgagactcactagacaaccccgcccattatgctgaaaggacccggcaggtgtcacttctgagaggggcgagcactccggggaaaggaccagggcgggggaggtggtaaagtcagtttctcggtcggcgcgcttgcacttcctctagctacgctcactccatcttctacttcagaaaggccagggctttctgcagctgcagctgctagtgcctggagggtgccatgtcccactctggttcatcctaagggcagacgtgggggcatgggaaagtggtgggggcaaccgtagtaaacagaaaacttaagggaggagatggcccacttaggactgtgaacagcattggggctgctgaaggagggcgacaccagaaaaatgcattgcagaagctgatgagccatttggtatggtatgttgatgagccatttggtatcctgaacacatgagaaaccacagtacgaaacaccagtatcagttttattataaatatcaagaatccagagtgtgttatgggtcagcatatgactttagccatattggaaagtagccgatcttcccttctctgtacctattaaagttcttattttcggggttctatcaacaccaaaatcctggctctacactcagttacactaaggtgttctagatcctgttttcttccaagaaatctgcatcatcaagagttgtttggagagggcgcaacactcatggcagaattttaggtatcagtttatggagctgtgctctaggatgtcactcctcctagaagcagctgcctcctgtgcagctctggtaagccctttgttcccaaattctccatcagagaggtgaaaagaagggagggagatagcctatgcaggtctaagcagtctttcattccggaacacctgacccgccaggagcctgcatcatggtccagaagcatcccctcctctccatgagttgccggtaggttcctgcttcacagatggtgcctccttccagaaagaggatttggtcagcctgctccaacaagctgagacaatgggtgataagaagcacagaccgaaagcgccgctcaggacttttgtacaggagctgcttcacctgagaaaagacacagactctgtcaagagcccagggagacacctgtgttccagagcccagacagctctcaccagcatcactgccacctgtgccaacagccccaaagaatcgaagattcttgttctgaatgcttctctgtctgacttttgacttattaaagactatttacatgaggtggcaacagtagaataaaagttaagagtcctaagatgaaacccataagaaaagagggaagggtatcaaatagtctctcctctctatgtataaactgggaattttatattctgttgtattttttttatattctgttttaaaagaaacataactcagtggcaaaaagaatgagcattcaggtcaggcaggcttgactctgggtccatgctctgctactcaacaactcaatgacattgagtaggtcattcaacctctttgtcccctttttatcctctatagtatgaggataacaatgccccagctcacaggcattcacgatgaataaatgaatgagatagtagaaagaaagggcttagcagcatgtctggcacacaataaaagagtaagagctcaactgacattaatgttattaggatggtcaggatgcctgggtggctcagtggttgagtgtctgccttcggcttggggcatggtcccagggtcctgggatcgagttccacaccaggcttcctgcagggagcctgcctctctttctccccgtgtctctggctctctctgtgtctcttatgaataaataaataaaattaaaaatatatatatatatataattaagatggtcttcttatgtttggcttcagagatttagaatctttagacagtctctttgaattggatcttggggagcagctattgggaactgaggattgcaaggattgattgagataattatgctagtacaaccataagtgaaggaaggaagattggggaggtagggatatagtagtcactaacaaaatgtctctcacccgcaactggctgtttgcatcaagggcactggtagcatcatctaggatgagtacacgtggtttccggatcaatgctcgagccaaggccactgcctgtcgctgaccccctgagagctggctcccagcctcgcccacctctgcagagacaagagccaaggtgagggctggataacccacacacctccacatatacactcacacatatacacaccaaggactgatggatacagctggatagggaaggttctgggaaggtgaacaagttctgagaatgaggaagcccataggaacaagatcctacagcttcaaagtgatgtcagggggttggaagaactacagaataaaagttccagcgaagatgtctgggaggggatatgagctgaaaaagcacctgtgtcatagccctgcgggagttcagagatgaaactatgggctccagacaccatggcagcagctatgacttcctccatagttggcttctggaccaggccataggcaatattttctctaaaactccttccaaatagctgtggctcttgtcttactgcagccacctaggacaaaatacatgaagagtcataggggcagcccaggtggctcagcagtttagcgttgccttcagcccagggcctgatcctggagatcccggattgagtcccatgtcaggctccctgcatggagcctgcttctccctctgcctgtgtctctgcctctctctctctctctctctctctctctctctcaatctctctctgtctctcatggataaataaataaaatcttaaaaaaaaaaagagtcatagaacaaggaacataagagtatggttatctagagattgacaactcaaaatctttattgaaagcatatcacaaaattactctctctctcctgacaccccatctccacccacggtctgtcattcccgggtcctcctttcagagtgctcggtgagagtgttcagtgagagttctcatttgatgtcccctgccctcccctctgccatcttcttgctcacctgtgtgtgcaggtagcggtgctcatattggggaaggggctctccatccagcagcagctgccccttagtgggctggtacagattctgcagcagggcagccacagtgctcttcccagacccattgcgccccaccagcgctatcacctcaccaggacgaagggtgaatgtcagcgcctggaggccagagaatcaaaaaataagagacacagtaaagcctttaaccttgaggcttcattgtcttattacatggcatgaggtcttacccctaggaagaaagggggggaaattggaaaaacatagcaattcctactctcccacaggcatagatttctgttcctcagggatgatggctccccaaggagtatagatggatggtgaggcaaaggccagagcaaagaccaagcaccactatgtcacacccttgatatcagatgtcatgagaaaacagaaagaaaaaaaaaatcccattctaaattacaaatggaaagaaaaggaagagatagaagatgagaggcagattttgctttagcagtttcttgggatgtaagactcttctcccggagagcctcttctcccgtccccccttagaaatccaagccattctagagtttggggcagttgtatggagtagacggggctcatctttgcctttgaggggttaggaagttaggaaggatctatctggaccttgtgttaggcaggctgaagacaggaccaaagtttaggatggtagaggtgagagtgaggctggtggaaaacaaggattggtaagttgtacctgcagcactgggacatccggatggtttgggtaggcaaaggagacatcttgaaactggacaaggccctccaaatttaaagaagtcaagacaccactggcaggacagcgagggatccggcccaggtattcaaatatttcctttgaggagcccacagccttctgtacactggggtaggtggagaatagtgcctggaggagcggtacaactactgagaagaggaaaacaaatctgcttgccagatttatgtgatatgacaaggataaagaatggaaggaaggtgacacagacggtgacgagacccaggaacgaaaaaccctgggtagtgacaatggaaggctctcacctccacagctgaggtgaactggatctggtagagaataaacgtgacaaggctcccgctgcttatagtcccatttgtcaccagctgcccacctatgtatagaattcccaccttcagcagcatccctgagatctgtggaaagaccacgggggtggggggaggggagggattgtggttgaaaaatctagaagggggtgcaaagaagcagactcattagcattatggagatatcaagttcttttcccccaggtaacagcaggaggcaccacaggggtaaaggaagcatgcaccagtggaggctccatggagtcttgctcaactatgactgtcctccccatcactgctgtcgtcttgtgtgaggagcatgtggctcctcacaaaaggcttttattaatgtaatgtcatctactattcatagcaagaatcctacaaacaaggttatactattcccacttttaaaaatgagaaaacatgggcacctggggggtgcagtcggttgaacatccgactcttggtttcggctcaggtcatgatcccagggtcctgatatggagctctgcattgggctccccactgagcagggagtctgtttgccctctccctctccctctgccccaccccgtgcttctctctctcaaataaatatataaatcttttttaaaaaataaaaataaaattaggaaacaatctcaagagaaaataagttactagcccatggtcacagagctagtaagtggcagcattgagccaggattcctgaatgctgctctcagactctttcaatgatgtaacagatgtccctcacccttggcttctgctattcccatggctctcactagcacatccacatagtcccagcatgatgctggcacaggtacaggaatttatgattccccgagttctgcctgagaggcaaagggaagccctgtgactggaagatagggcatctccccaaaagatggcgcggggtggattcagtgtaccatggtgacatgaagccatccagcgggtctaaaaaagagggaggcagttaagaacactaggtagggtaattgagctccagcctgctaggatgagaacaccaaaccactgccggggtgtgtggagcaggattaatggaaaagggaatggagtcgaggcatctcagggacaagggaacaggcattcttctccaggtgctcacactggtgatccagaggttgactgcataggccagagcctccttctgatggagggtattcattttctgcagcttttggctaaacttctgggcctcacactcctcattggcaaagctccggactgtgggcattgctgacagcacctcaatggccacctggctagactctgccagagatgtctgcacctgtgtggccaacacctgcggagacatggacaagaactgtcacccagggttggcaagccatcagggacactactagcacctgagttgcttagtcggagattaaaggtgagaagaggcaggtagatgaaggaacgagaaaggggcacagttatacctcctggatactgaagagttacagtggagaggaaatttttactgagaagggtcacagggaatcataatcttgagagtggtgatcatgttcataaagatggattgtgggcagaagttagaagacacagagagtatggagcccaacactgagcaatctggggacatggactacggggaaagggagtcccatggagatggggaatcacttgagggtgccaggaaagaaacctcagaggagttaaatccacccaatctgggaaatgaaggactgcaactccctcgacatacctggtgccatcttcctagcttctcaggcagaaggaaaagcagaggcagggtgaccacggtgaccatggtgagggacagtgactcccagagcatgagccccaagagacacagcccccgtaccaggtaccacagcaataggctcagcttctcactcagagactcactcagggtggatgtgtcctctgtcacccgagaagtgatggctcttaccaggggtcggggagatggaggaggaggagagagggggtagagggggtgggaggaacatggtgttctgaggaggctgaggaggacaaggtaaggggaataggggagtttagggatctccatgcagggagaatgagtattggagaggaaaaacctggccaaagactttcgttttaactataaagaaattgattcctatgtgaatttccatttctctgacacatctctgttccttaaagatgtataccccatgccgcacacgagggcgagctggtcacataacaaagctggacaaaaaacagagagtgctgctagaaagcagtccagaaaactctactgagctctgggctgggaatcaaaagatgggttctgtcaagctcatctctatccatatgtgaccataccaatttcagcatttagggtctgggcctcaggttccttctctgcaaaataggcaattggactctgtgatctcaaaattttccaggtcttaaattctatagtttctatctaaatatacgcacagggatatatttatggaaaaatcttagatggaaaaattaggtttttctgaaggtaaagaacataatactcttgaggtataccaagaataagaaatgacaatgtggcaatgtgtgtgtgtgtgtgagagagagaaagatcatggttataagtaaaagatggtatatggggaatataaagagtgtacagatgtgtaatgagtttcatgaaacacctgtttggttctgttggaaaaactctgtttcctggcgcaggacagcctgaaatacctctccctgcacctggctgtgcacacgacccatgatgctgttatagactccatcacccaagaactccagcactgcactagagagagatggggagaagaaggatcagggtgtattcaggggacagagagaaggtcccagagaagtgcactctgggcagcatcaccaacttccagctccctctttttcagggtcccccatcctcagcttccagctgcagcccccagacctggtggtggtgagaatggacatgagcgttatgtttcgtgtgaaagcagaggccgtctcatcttgtaaaatccagtcagtgaggtggccagtgaagaatggaatggccatttcccctggaggggaagaggagggaggggtcagtcacaaatatcaggtctaagcagatcagttccaaccagactgtctcctcccccatccgactctttcacctgtcaccagtatcctggagccggcagaaagagcacactgaggacccagccctgcaccctggaacccacaaccctgaaccccagccccaccagaccttcagggggttatttaggaagaccagcggtcatagggcatgctgcccagaaaaaaggacttgcccagggtggctagtcctagaagacactggagtggtcttctcacgaccagagcccggccgccttcccctgatccacatttcccagaacccacaccaaccgatctcactgccccttagtaggattcctgcccaggctcctgtggccgcccctctgcccctgcaccctcttaccaagactggagagaaccaacagggccagcaggagcgggaggcggcgcatctctgagcccaggcagcctagaagccggcggaccgcgtcccctgaacccccccgccttcccggcgcccagagtccgctgagcttatgccacagggcggctgcggacaacgctgccaagtaactgagggcgaacacatccaggcgactcccccagtgcaggagcctggggctgtcggaatcccggggggctctccacgagcgcagctctcggaacaaggcaaggccgggcagggccaagcccagcgccgccgccgcgggctgcagagccgccagccatcccccgagtcccgcgctttcgcttccggagcccaccgccgcctcgagcacgccgcgggcgcccagccacagcacagccgcgcggctcaggcccaccacccaggccgggagcaggggcggcgccgtggggaccagcacggagcagacggcgggggagcacctcccgggagcagcgcccagtcggcgagaagcagcagcgccacccccagccacgccaggcgagctcggggcgcgcaggggcgcccgccgggactggggggccctgagccggccatggggtcgcgccacggcctgggagtctccgtcgtccccgccgggccggaggctcgcggtgctgcccgaggctgtgcggggagagggcgctgaggcccacggccgggagcggggggcagggcgggcggcggcggggtctcggaaagtcccggcacccgcgggctctggccgcgccgcctgaagcctgaggtttcgcggaaagggaaaccgaaagcggccgccggctcgggaggtccgccgggctgcagggggaggcccgcccagactattttgggagagaaggcgtggaaaatagatctgaggttctggggagcagccttgcggccccaccttctccatcatgcacacccgtccttcctttctttgcttcctctggcgaattccacttgtcgggcttctcccccccccgccagcctccggaccgtgttaccccagccccttccgtcacccgtctccgggcagatctgccccgggcaggttagcgccgggcgcgaagcctcacgcaggacccaggcgcccctagcgggcggggcgaaggcgcggggctggagcgggcgcgctgcccgcggtcccgggagaagagcagcgccgcaggcggcaggcagcgcggcgccgggatgctgcgggcgggagaagtccacactggggtgaggagtctggctggggggtcagcggagaggtggaggaaggggagagacgggggggccccagaggccccgcggggtgaacgcggggaccaacagtgaggagggagtttgcaccagccagtgctggcagaggtgccccgcgtcgaacccaggcgtctctgttctggaggggctccggcgggagtccgcggaggcgctgcgcgcgcgacgctgggggcgggggtgcaggcgctttggctcttagcgcaagcagcgagggaagctgctctaaagcgctttcgctttcacctccggactatagagaggggctgaataaatcaagggaggggggtggagaaggtgcaaactgatgcagaaatggttccctgggtgaagtagggcagcactcgggcgagggcaatgtgggcgctgattgggaggggacagctcatcacacacacctttgatacactggccgctgggttacccagagccacagcccagatagcgggggttccttgtgagccggtggtgcccttgcccatcctcgcccaagaaggctcccgcttggctgcccaggggctgccatgctctcttccctgtgtcctgccggcctgcccaaggctgcctggcttctgctcccaaactcctgccacaactgtccgcttgggggtggctttactttagagaatgacctctggagtggggctgccctttttcaatggccctcaattcatggtgaatcagtctgtgggaaagcactggcagggcaatggccctggagcctggacccacagagtgatgaggattcactgaaaccatttgtcaggtgagcagtgggaaataggaagcagaagtcaaaacaagagatgggagttagacctgggcgttagtcccaatctgctattaattctaggtgaccttgactagtcagtcaccctcctccatgattcagtttcttcatttgaaccaaggatctttaaggctctttgcaactcaaagaggagtagaaaacgtagccttatgcctttcaccttccttaattcttttccttaatttcttttcttggcctgaaaagtcaactcaaactccccaggcaaatcctctctcgtacagagctcttcccctggctactgagatgcacattgacctcttgatcagaaatccttaaatgaggggtgcctcggtggctcagtcagttaagcaactaactcttgatctcagctcaggtatccatctcagggtcctcctgtgttcaagctctgtgctgggctctgcactgggcatggagcctacaaaaagagaaaggagaggagaggagaggaggggaggggaggggaggggaggggaggggaggggaggggaggggagaagaaaagaaaagaaagaaaagaaaagaaagaaggaaggaaggaaggaaggaaggaagagggagggagagagggaaagaaagaaagaaagaaagagagagagaaagaaagaaagaaagaaagaaagaaagaaagaaagaaagaaagaaaggaaggaaggaaggaaggaaggaagaaagagagagagaaggaaggaaggaaggaaggaaggaaggaaggaaggaaggaaggaaagaaagagaaagaaacagagagagagagagagagagaaagaaagaaaaagagaaaagaaaaagaaatccttaaatgaaaccattttttattttattttaaaccaactcatgtgttcctaggctgcctccttccttccttaatgcctgaccctgctaaccaccataccacttgttgattctgttacttaataaactggttaaggagtatgggggtggagaattagggccaaaaaaaaaaaaagacatgagcttgtttcccaaggtcagagtaaccttccctgtgttggggctgaccacatctgcagcaacaagcacatgtggtggtcattcacttgtggggctgcctcacccaccagtgattggaagcaccccatccctcctccccacgccccgagccaaatgtctacctctgcaaacctcatcctcacctctctccttatggtgggaaggattctacttaggaaggttggggcctagagataggattctttctatgttgttgccaccaccaggctctgacattcccctgcagttgggagaggagatggagatagtggagagatagaggggatatcctatactgggagtcggctctggcctaaattgctaaatgatcttgaatcggtgacctcctttctctaggaatgtttcctcatctgtaacatgagggaatcaaagctcatcctgctatgacattccatcctctgtgtctccacagacaaccatcatggcggtagagtttgatggaggtgttgtggtgggttctgattcccgggtgtctgcagggtaagtaccagtcaaggtgaatgcttctggaaggaagccaatggccccaagtacagattttttcttacccattcatgaagttattagtaaagcggagcttcgcagaaactgagttaaccttttagaaaggcccctataatgagatactgggcaagtgcttgggtccctaaattcatggagaatctggggcctaaaagcttatgtggcctgtccctgcagggatgggtataaaacgatagggtatgagaagaaggtaggatgcaaagatttcaggggcctgccttccttttatgtttagagatagagaagacggctctgccaggaagatattctggtttttcatccagcacatgttgatctggttctgtctcctccattctggccagtttccccctatgcaaaatgagtatatgggattaggtcaatatcacttactttacatcccatagaacacaaaactttctcaagatggatagagcaaagaatttcttaagaatattattcttaatttactatttttttgttttattattaaatctaagcctgaaaataagtctaactttgatcattactttctgtttcatttatttgagattatttttttcttcctgttttaatccaagtattaaatatcatggactcagggatccctgggtggctcggcggtttagcgcctgcctttggcccagggcgcgatcctggagtcctgggatcgagtcccgccttgggctcccggcatggagcctgcttctccctcctcctgtgtctctgcctctctctctctctctctatgtctatcataaataaatgagtaaatcttaaaaaaaaaaaaaaatcatggactccagtgctcttctcttgtcaaataaatttgggaaacactgattaacctaaaaaattctggcgttgctaatgttgctgcctgctgactccttccctgcagagaagcagtggtaaaccgagcatttaacaagctgtccccactacaccaacacatctactgtgctctctctggctccgctgctgatgcccaggccatggctgacatggctgcctaccaactggagctccatgggtatgaagctttggggatcttcaagtccacactcactacagttctcccaaccagcaaaccctgagacagtgtcattcctgttccaggaacactgctatgaaaaatgaaaatttctcatttgggctcctgtttttattagctttgaactggcacttgaaacctggtttccacatctgtaaagtggagataattaatagtacctaccttacctcaccggacagttttgttgagaatcaaatgatctatatgaaaatggcttgaaaattgtcaatcactatcctactagaaatagcgagaaagaaaatgatggtgtgcccaccatatgccaggcagttactgtgtgagagaccaaggtcattagtgcagaagtaaagcttatttggttttactcacacgggcaaggcccttgcagctcagagttatataactgggagagggtgggtggggcagtaaaggaggagaacgttgaaatctccttaccggtcaggacgagtgcgagactcggcctcctgtgcatgtgggagaggagctggagtttgaactattgcagctctaggtttcaggtttcacatgtcacctggcagggacaatggtaatgggcacaggaggggggaacttcaggaaactctattgacccctattactaatatttcttttaggttggaactggaagaacctccccttgttctggctgcggccaacgtggtgaggaacatcagttataagtaccgggaggacctgtctgcacatctcatgatagctggctgggaccgacgagacgggggccaggtgagggtcttcccacgtacaccctcccttggtgttcctcagtaccctacagagggcgatcgaggttatatgtcattccagcaatgggctccaaagaccccgcctctaaaagtgtagtataatcgcaacccatgggggtaggagaccgtggggcttcattgcagaacacggagacacgctgactgtctcagtggcaaggagaggattgacgcttccatggtctaacctgaggatgccttccccaggtgtatggaaccatgggaggaatgctgactcgacaacccttcgccattggtggctctggcagtacctatatctacggttatgtggatgcagcctataaaccaggcatgtcccctgaggagtgcaggagcttcaccacaaatggtaactcaccaaggggaagggtacctgggggggatttttaaacatgagaaggaagaagagtatgaggaatatatgggtgaccattcaatttaatgtccaaactggaacactttgagtgtgaaaggagcaggacaatgctaaactaattgggacttcagaaccaaaggcatcaaccaggactgtcctgagtatattcagaaatatatatggttactataagaattcaaattcaaattcaaatatacggttactataagaatcagtggtgtgctggagctgacttgggccagctcatgagagccaattgttaaatatccaatggttcctgagctgctcatttagctgtttataacttgaaatcaatcacggtaggagttttgagtttggataccaggagatgtaacacataaagggttttgtgttgttgttgttttttttaagttgatttactagcacattacttgatgtgtgttccaaagagatgggttttgaggtctgagagtggtagtaagcatatgagcgggagaggaatgtaaagatttctgaagttaagttattttctctccccctctctaccctgaaaccctctacagctatcgctctggccatgaaccgggatggctccagtgggggtgtcatccacctggtcactattacagctgctggtgtggactatcaagtaatcttgggtaacgaactgccaaaattctatgatgagtgaatcgtcctcccttcattattttgtaataaactctttcagaccagaacctggtatggtcaatggaaaatgggtgctcagggggatgaagtttaggtgggggcttcttcctcccagatgttagatatcctttcacaatgccttcattcacattagagatcaatacaagataaatgcttaaaacttagggatttgtacatttcaaaggatgataacaatagccaaaacactgactaaggcattagcttaatgcttataagctttatctcttagaaacaaacaaaagacctttatagcttatactactatatctatttacagacagatgaaggcttagaaaaagtaagtcccttgaccaaagtcacagtgaattcaaagctgaaaactgggatttagttgggttttttgttttttgtttttttatcatatgcccttcctctcccattacataaaactttcattccctcaagcttcatgtatcatgtcctcccttgaaatctgcgataattagcccagcacagtagttgacacttaggaagttacgagcagatgcctgagtaactgttttaaacaggccaaattctggcccccaatctttaccaggcacttctcaagtgagaggacaaattatttcctttctgtgagctctcatttctgtcaaatgaaggtattgagcaacttctaaggtggcttacagctagaacattcaatgccattttcctaaaaggtaaacagttaagaggtatatttaacagcaatcatagtgagatccccagggagcctctgtctacttttctttctggatctcaggcttaacatataaattcaaaagtaccgcaaacaaacctatgtccttgggagcgtgtgtttggtttggagggggaaaatcgaaaactgtagagacttgacttctttctagccaaataaattggttagttctttctaatcaaataaatttaaatgatatttaatttattttgaggtttaaaataatagtttaagagccgatttcagggatccctgggtggctcagcggtttggcgcctgcctttggcccagggcacgatcctggagtcccgggatcaagtcccgcgttgggctcccgggatggagcctgcttctccctcctcctgtgtctctgccctctctctctctctatgtctatcataaataaataaataaataaataaataaataaataaataaatcttaaaaaaaaaaaaaaagagccaatctctcccatggatcacaactagaggaactctggaaagcagacaaaaagcaggcgctgaaggattccagaaagtagacaaaagcaggtggggtataaggagagccaaacttggacaagcaacactgcccaggggtggttttccatttttccccctctttcatctcccggctttgccctgagaagtcaggcctcaggtgcaaagctgcggtgccctaacttgccaagagaaacaccaaagttggttctggccagaggaatggaggaagcagacaaaaggggcccaggaggtgggaaagcgtaggaggtttcccacatgagggaactgatgaaggggattccttaactctaggttggaactctcacaagtaccggtgacccctgagctacacaaacgtgaggcacacccaaaacaccacagcgtggactttgagagctgaactaaggtttaagccttttaaaattaggaatctatctttttatttattgaccagagtcttatccttctgtcccttattccaaagagtgcttgtagcagctcccagagacaggcacaatttaaaaagaaagagaaggggatccctgggtggcgcagcggtttggcgcctgcctttggcccagggcgcgatcctggagacctgggatcgaatcccacatcaggctcccggtgcatggagtctgcttctccctctgcctgtgtctctgcctctctctctctctctctctctgtgactatcataaattaaataaataaataaataaataaataaataaataaataaaaagaaagagaagaagaaactgggcaaactgaaaataaagctaagaaataataaagccaaggtgccaaactaaaatacaaattaaaaagattttatttatttatttgagagagagaacactcacagagcgagggagaagcaagctccccgctgagtagggagcccaatgcagggctccatcccaggaccttgggatcatgacttgaaccaaaggcagacgctcaaccaactgagccacccagactccccacaaaataaatatctttttaaaaatggagtacgggagctggctaacaagagcaaattgtaaaatatttggtaattttggttttttttttaaagattttatttatttattcatgagagacacggagagagaggcagagacaggcagaaggagcagcaggctccatgcagggagcccgactcaatcctgggaccgcaggatcacaccctgggccgaaggcaggcactcaactgctgagccacctaggcatcccatattcggtaattttgaaagagagttgttgaccacaggtaccttcacgttggccttgatggaagtatttattctacagaaaccaggaatattacatgtcagaattgttttgttttttttttccccagaaagccggtttaacaggacatatatttatcacccagctacagctgagtaagaaaacagttggctctgagttagaaggtagtgaaagcacagaggaaaaggaaactaggtacaaggttcaaaagattcattttaaaagcacggcatagggaatgtagtcaatgacactgtagtggtgttgtgacagacggtacctatacttacagtgagcacagcataacatagcatataaacttgtggtatcactatgttgtacacctgcaactaatgtaacattgtgtgtcaactatacttcaattaaaaaaaaaaaaaaaaaggattcattgaaaagaaaacaagccaatggctgctgggtggcttagctggttaagcacctgactcttgatctcagttcaggtcaggaactcagggttgtgtgactgagccttgaatgggagggtccgtactcagccgggagtctgtcaaggattctctttctcccactgcctctgcccctccccaccaagtaaataaataaatttttaaaaagccatccaacaaaaacaactcctctctatagatgtatatttttcacatcacacagcggattgatttgctaaaacagaatatgcattatgccataaagaaaactacaatagatttcaaagtaccagtatctttgaaaaaaaaagctacattttgtagtcatgttgtaaaaaattagagttttattttaaaaaacgatacctaaaattcagtgtgcaaacagaaaatattgataaattacatggttttctaaggcagtcataaaggaaattaacatatttagaactaggtggtaaaaatgttgcatatcaaattttgtgagatacagttaaagcagtattcaggaagaacatttttttaaaagattttttaaagattttatttatttatttatttatttatttatttatttatttatttatttgacagagtcagaaagagcacaagcaggagaagtggcagacagaaggagagggagatgtggactcccctctgagcagggagcctgatgtggggctctatcccaagaccctgggatcatgacctgagctgaaggcagacacttaaccaactgagccacccaggtgccccagcttcataaatgacctaaaagttctccaaaattttgaaaaagagcaattgagcaagcttaaagaaataagaaggaaggaaataataaagataagactagaaagcaatttaatagagtacaaaaactatgtagtaaaaattcacaaaaccaaaaactagtgacttaaaaaaaaattgtaagatattcagatttagaacaagactgatcatgaataaagcagagaaaaaaatgaggaaacaaaatacagaatggaaaggaagggtataggtacagatataacagatacaaaacataatacaagatgtaatgaacaagtatatgataataaattttacattttttgatgagataggtaaactcctagaaaaacttaatctaatgcaattcacataagaagtaaaaatttaagtacagcaataaacattgaagaaatgaaaaatgttgataatggcatctgataaaaataattttttatatgcccacatggtttcatgggggagttacaccaaacatccaaacattcaaggaacatacaactcttatcttatgtggttttttccccaggaaatagaaaaaacattaaagttgtgtagctaattttatcaggctagcataatcttgatttcaaattgagataggaaattcaaggaaagaagacaataggcccatctcactttgaacatagatggaaaaaataaataattatctattaactgagttcaactgtattaaaaataataatacacactatagaaaagaaactgatggttactagaggagaggtgggtgaggggatgggttaaataagtgatggggattgaggtgtgccctagtgatgaccaccgggtgttacatgggagggttgaatctctatatttattatatacatgaaactaatattatactgtatgttaactaactggaatttaaataaaaactagaaaaaaaaataatatattgagatcaaatgagaaatccttagaatacaagaatacttcaaaatagtaaaatattttactataattcaccataatcatagactaaagaggaaaagatcatctgcttttcttaatgcataatttataaagtttaatttacaaagttaaatatccgtttatgatttttgaaaaaccagtcttaacttgttccttagaacccagaatcatataaaactttcttatcattgtgaagtttatattccaaaaaatatataacaagcagtctgcataatggaaaaatcttagatgcccaagaccactcactataattactagtaaaatatagcactagagttcagactggtgtataaggaaagaaagggatgtgagtgaagcagataaatttgcagatcatatgatactctgctcagaaataataacagaagcagcaaactattaagataacaaaagaggccagcccgggtggctcagcgatttagcacggccttcagcccagggtgtgatcctggagacctgggatcgagtcccgcgtcaggctccctgcatggagcccacttctccctctgcctgtgtctctgcctccctctctctgtgtgtctttcatgaataaataaataaaatcataaaaaaaaaatagaaaggtggatcctgacctactaccacatacaatagcaggtgagttgaagcctcaaaagggaaatgtgtagctttaaacataacagaataaaacataaaaattatctttgggactagagacagggaaggacttccttatataacctctgaaaccatcatgacaaatattttattatttcattacatcaaaagtgaagacttttttaacagacaccatagacaactctaataaacaaattgcagaatggcagaggatatttacattatctgaaaccaattaaggataatatctagaatatacaatgaaatgcaaaaagtaacaaaaaagcatcaataccctaggaaaaaaatgcacaaaagacataaacatgaactttatagagggagaaacaaggaagctaatgagtgtttaaagagataatcaaactcgataaaaatcacaataaaacaaatttatacattactttatacctattagactgggaaacataggagtttgctaatgccgaatattgatgtacaaatagggaggagggaagcctcctaccctgctagtgtaaatgcaaactggtgcagccattctggagaaaattctgcactacttaatcgagtgaaaaacatataaggacccaacagttccactcctggaaatacatctaccctttgcaactgtttccctgaggagacctgtaagagggagttctttataagtcatttgtgatagcagagagctagaggatcttcgtgtctcccagagagacaataggacaaatgctatgagtgcacatagtaacgtggattggtctttgaaccagaggactaaggagcaaaataaaacctaacagaatgagctttaagcacaaagcaactcactttgaataaaaaaatacacacaaagccatacacatttttcaagaatacgtataacaaaaagatagatacaaagcacatgagaagggttgcctttagtgaaaggaaaggaaactggaatttgggaaatgtacatacaaaggaataaataataacaaacatagaaaagattttgtatggaccaatgatgaccatgcaccatgaactgaggaatatgattttttagttaatgagtcaaagaaaaccatatctctgagagcaatttattctatatttccatgacaggtattagatagttccctattttttccatccaactaaatagatatagttaaagtgttcagtttggagattaggatttagaaagggaggatagaaattagaaaatctgagattattccctacatttacagcatctctctccaataatatgcattacttgtttattctaaatcttttggaatctaataaacatgttcttttttatataatgagcctatatgaatgatctttggtcctctttaccaaattcttaattctgcaggttacagacatacattgtaagaagaaaaatgtcttaatcccattgagcttattcagaagcactgggaattggttcaacaatattcagttttacccagcaatgtttatgacagagttgtatgtgtactacaagcatgtatgatgcagacgatacgttctcaaaaactcagagatgaagtatatccatactacatcaatttttatcgaaactctgtggacatgcaagagagtggatttctctgggaagtgccttcactaggaaatgtaatagggttctccagaaaaatagaaccaatagtatgtatatatggagagagacttattttaagaattggctcatgtgattgtgagtactggtaaattcagaatctgcaaggaaggttgggtatgtaagggagagttgatactgcagcccaagtccaatggcagtctggagacagaattccctctttttcagtgagcctcagtcttttcctctgaaggcctccaacagattggaagtcccccacccatattatggagggtaatcagctttactcaaaaatctactgatttaaatatttctcatctttaaaaataccttcacagcaatatctacactactacccaaatatccgggtaccttagcctaactcagttgacacaaaatcagcattcacatggctcaaggcgaaacttcaagataaatatggcgggagtcctgaggaaggaaatggactccaaactaacccattagggcagtgaaacatcactgaagtgtcggactaacctcacatcccaagtaacgtgcaaccaggttttagattaggagaggtaccagacaaatgctgggtgatttccttgaggctttttgtccctacctttataggctgactgttttagattgccctagagagcatacaaagaaaaaaagagtaaattaaaagcttttcatccaaactcaaaaaatgaatgagaaatttttaaaaaccactgtagcggcttcttctataacctagcacaggtatagatgagggtcatagagctattaattgtataaacccatagggtattttatgctaagataaggccactagttggagtggatttggactctgagatatgaaatggagacatatgaacagacacagggaagtcagacaactgtgaatcaccaaatccctgaatatctttgctagaagaagcagacccattgcattagctatcaccctgtcatacccactgtattggttacaatacaaacatttactatggggcattattaggactataggagaaatttgaatgtggactgtgtatttgataacattgtatcaattttaagtgtgttgggggtgatggtggtattatggttatgtgggagaaatgtccttgttcttaaaacacacatgcccagggatccctgggtggcgcagcggtttggcgcctgcctttggcccagggcgcgatcctggagacccgggatcgaatcccacgtcgggctcccggtgcatggagcctgcttctccctctgcctgtgtctctgcctctctctctctctctgtgtgactaccataaataaatttttaaaaaaaaacaaaaaaacacacatgcccaaaagccaaaaacaaaaacaaaaaaaacacacgtgccaagctatttacgggtgccttgtcataatgtccacagattattttcaaacggtttaacaaaaataattcctcaacaataaacagataaacaaaatgttgtatattcatacaatggaatactgtacaagtgatgcatgtgaaaaaattaataattcaataacatggaaaaatctaatagaaacaatactgagtgaagattgcagacacacgcagaatatacaatgtatgtttcagttatctattgctgtgtagaaaccacccctaaacttcatggcttaaaacaaaaacaatcattttattatctcttgggagtcagtaggttaggtgggctttaaaaaatactgatgtagcccatgaaccaaagcacttattcatagcagactctccacacagcatctctcattccatgtgtgaatactggttatgttttctggctggctatgggatttggaaatctttagaatattctaaaattttccctccctaatgagtcctgcctccccatagtagaaatcagaaaagtcaattccctagccctctttgaagctagggcacctgtcaagttcatccacctgagacttccattcaaaactgggcagggacacctgcatggctcagccgttgagcatctgcctttgctcaggtcgtgatcctggagtcctgggatgagtcccacatcgggctccctgcatggagcttgctcctccctctgcctgcgtctctgcctctctccctgtgcctctcatgaataaataaataaaatctttaaaacaacaacaacaactgggcagcaggaggaaatggagatccactctacattcatttcactaacaaaggtgacagaagaagcaactggcttttgggaaaatagtgatttaaaaaaaggagaagttcctggaacagaagtggttgaggaggtgtcttcagaattggttgtggtaaaggaatagaacaaagagcaacatttagaagtagtgaggcagcagcagtgatgttgtttaccaaacgtacactgtgtgtgtggcggggggaacagcgtggtcttgttctgtttataatcaattgtctcagtatttccaccccaaaatcctaattctgagagacatgtatattttagactttttgaagtcttatcaaactcattaatgaaggagccagtaagaataaaggagacatgattcaaagaccaaaaacaattgcaaaaccaagatatacctagtcaggaaaacttgctgttagagattaaaaatggttaatgtacaacaaggcaataaaatcataaccttgaccttatcttctttaccagagaaaaagcaaagcctccataccttgtcaactctctccagattaatctctaatagcacagggctggctgcgttcttcttactcaagttaagacacccagattttgatcaggcaggattatgagaaagtatccaaatatgatattaagtaatcaagcaagcaaaattttgccttatttctaatttttagaacaatttttcctacgccattcctgtccccaaggtacagaattgaccaaataagatttttcagaaaaaatttttaaaagattttatttatttattcaacagaaagaaagagcactagcagggggagcagcaggcagagggagagggagaagcaggctccccactagcagggagccagacatggggctagatcccaggaccctgagatcacaacctgagctgcaggccgatgcctgactaagccacctaggcgcctcaatttttcagaaatgtttcaattcaatatcattaatgggattagtctcttttatttagccagtttaggactgagacataaagagctccttgttacatgtttggcaaagcaagagtcttttttttttttttaattttatttatttatttgagaaagagacagagaaagtgcatgggcgagggctaggagcagagggagaaggagaagcagactccccactgagcagggagcccaaggcagggctggatactagaatcccaagatcatgacctaagccaaaggcctagacgcccaaccaactgactcacccaagcgcccccaaagcaaaggtcttattatttttattgaagtatagttgacatacaatgttatgttagttgcagatgtgcaacatagtaatttgacattgtaagtcctatgtaccatctgtcaccatatgtaattattatgatatggcctatattctctgtgttgtactttacatcccggtgatttatttattttataactggaaatctgtactttttaatctctttcatcttttcacccatccctctactctcttcctctctggtaactaccaatttgctctctgtgttaatgaatctctttctgttttgtttgtttgttcatttcttttctttcacagattccacatttaagtgagattatatggtatttgtctttctctgactaacttcacttagcataataccatctaggtttatctttgttttcacacatggtaagattttattctttttttacggctgaataatgtttctgtgtgtgtgtgtgtgtgtgtctgtgtgtgtgtgtataaccacatcttgatcagttcatcaattgatggacacttatattgctttcatataatatttggctatatatataatgaagattaatttctaaaagtcaactgtctattttcttttaggatttttctggtttcaggtcttacatttaggtctttaatgcattttgagtttatttttttaaatggtgtagggaagtgtttcagtttccttcttttgtatgtagctgtccagttttgtcaacaccatgagaggttttttttttttttttttatttaaattcaaattaggggcagcccgggtggctcagcggcttagtgctgccttcagcccagggcgagatcctggagacccgggatcaagtcctgtgtccggctccctgcgtggaacctgcttctccctctgcctatgcctctgctgttgctctctctctctctcaatctctctctctctctctcattaataaataaataaaatcttttttaaaataaataaataaattcaagttagttaacatattaagtagtattggttttaggagtagaatttagtgattcagcacttacatgtaacacccagtgctcatcccaacaaatgccctccttaacacccatcacccatctagcccatccccctattcacctcccctatagcaaccctcattttgttctctatatttatttattttttaaaaggttttatttattcattcatgagagacacagagagagagagagaggcagagacacaggcagagggagaagcaggctccatgcagggagcctaatgttggacttgatcccgggtctccaggatcatgccctgggctgaaggtggcgctaaaccgttgagccacccgggctgcccatgatctctatatttaaaaatctcttatggtttgtctccctctctgtttttatcttattttattgttccttcccttcccctgtttatctgttttgtttcttaaattccacatatgagtgaaatctatgatatttgtctttctctgattgacttatttttcttagcatcatactctctagttccatccacattggtgcaaatggcaagatttcactctttttgtttgccaagtagtattccattccaacaccatttgttaaagaaactgtctttcccccattgtatattctcttttcctttctcagagattaattgaccaaataagcaagggttcatttcttagttttttattctgttccactgacctatgagtgtttttgtgccagtaccatactgttttgattattatgtataattatcgtagtatagtttgaaatcagggattgtgatacttcctgctttgttcttctttcttaaaattctttggcttttgggggtcttttgtagtttcatacaaattgtaggattatttattctaattctgtgaaaaatgccattggtgttttggtggagattgcattgactctgtatattgctttgggtagtatagacattttaacaatattaattcttctaatccacgaacacagcatatatttctatttatctgtatcatctccagtaactttcatcaatgtcttgtaattttcagaccacaggtctttcaccttcttggtttaatttattcttatgtattgtattctttttgatgcaattgcaaatgagattattttcctaatttctttctgatagtttgttactactatctagaaattcaaccagttcctgtatattaattttgtatcccacaaccttacagaattcattattcttctaaaattctctggtgaagaagtgcctgggtggctcagttcactgaaaggccaactcttgatttccactcatgtcatgatctcaggttctgagatcaagccctgtgttgggctttgtgtactcagtgcaatctgcttgagattctctctctccctttccctctgcaccttcctctcctttctctcgaaagaaagaaaatctgtatttaaaaaatgttatttttttttacctgaacagaattaatcaaggaaggttgaacttccattctttatttgtcagctttttctacatcatgggtttgatagacagggtagctcttttgataatacagaattaatttaaaatatatagagcatgctaaatgcacctaattacttccattcctcctacattttatgataaaatattaagtctttggtgccaccttgtggtcaagtaggtaatgattacctagtggaaaaaagcttttttttttttttttttttttttttttttttagagtcaaaaggtatcatcaacagttgtaatatcctgaatccaggatctgggtttcaggaaagcaacaacaacaaaattctggtccaaactgattacttagtcaaatgcacaactatctgagagtgagcaatcgttttagcttttgctctcccaataaccagagtgacagtaaaacatcttaaaataaatataaagatggtaacatgaaaattataagcaaagggattttacttgttttaaaaatgatttgagaaaattacactcagcacaaagcactcaaaggtatcaggttactgagtgagagtattctaaaataaatcttcgctagctaggcagattataatagaggtaaaaagaaactttttctacctctttttaagagtataatgaatattctatgggcagcctgggtggctcagcagtttagtgctgccgtcagcccagggtgtgatcctgggaagccgggatcgagtccgacgtcgggcttcctgcatggagcctgcttctccctccacctatgtctctgcctctctctctctgtctctcataaataaataaataaaatcttttttaaaaaaaaaaaagagtataataaatattccaagaccaagtttgaactacaagttttctacttttttggttgttaattttaatctatcattatgtatgcaaccatacaaaaatatgtatatagttagatgacagtactatttaactttaagatgtaactaattttattaatactacactaatatgtatgccacattgaatttaccaccttgatttcagttgtgcaacaatgaatacagataacagtgtatatataaaagctgcttaatgacccagtgctttctctttgtctctatgaagtacctctttttgggggaaggggggtaatataaattcaaattaattaacatatagtgcattattagtttcaggggtagaatttagtggtcatcagttgcatgtagtaccagtgctcattttatcacatgccctccttgatgcccatcacccagttaccccatcctccacccacctaccctccagcagccctcagtttgttccctagagttcacagtctcttagatttgcctcccctcttctggaatgaattcttttcagaattttgtgggtaatccaaagtcacttattcattaacttaaattaatccgaagacataaaattcatttaagttgaaattataaagcaatataattgctattgatcttacaaatttttcaaagaagcaaaatttttagatttcacaaagaaagtggagtacctaagtcaaatgattttgacattgtctaaagttcacaagagccagtcatttaaaaaaatagaggctgtcttctgacaatttggattagctgcatttgtttacctttaggttttcttcccataaactgagacaacaaatgagtcaaagaataaggaacaaatctccattttttcttccaaaaccaattaacagtgattaaaatcaaattaatagctgtctgcagtggggcgtccaaaggggtagaaggagattacaaaagggcaagagggaatctgagaggcaacaaaaatatttgtttcatgtaaattacacctcaataacattgataaaaaccataaaatgatatcaaaagtttcagttgtgaagtttgtgagctttagcgacaaccaaagaggtcatgatatcgagcatagcacaaatataccttttcccttttcagtttttaaaatttagtttattaaaactaaaaaacaggggatccctgggtggctcagcggtttggcacctgccttccgcccagggcgtgatcctggagacccggaatcgagtcccacatcaggctccccggagggagcctgcttctctctctgcctgtgtctctgcctctgtgtgtgtgtgtgtctctcatgaataaataaataaaagctttaaaaaaataaactaaaaaacaaaatacaacaactcacccatttctaccaccatctatccccacaaatttgtaagtctggtaagttataatttgcttccaacaaaatagaaagaggacctaaccaagttgtaagctgttataatatttaaaataatttttgatgatacatcactatttgatttagaaaataaagttctgcagaaattcaaaattaagcaaaattgctatgacaaaattccacccattaccacctccttatctatctgcacagtttccaagtgcttaaaggaaaattcaaaataaaaccaatgttgcatttttgtctcattctagaaataagtattatttatccactgatacattaaactagttgggaaaagcctcatctatctcactaagagattcattgtcaagataactttacgttttcctagttgttaattactgattaaaatgtctaataaatttatactcttttcaaaaaataaataaataaataaataaataaataaataaataaataaatattatactcttttcatcttggtgtactataccaaattgcaataagtcaaacaaaacaaacactttttttttcattgaggagcattttatttgcacgtatgtattacatctctagaaaaagaatccctggattttccctcctgtgtgaaactattgagggacaggagcaggttattctgcattttttctagatctttcagttgtacaccaaatctggggcaaatcagtccacatgtgtttaacctgcctgtgaggctcacaaaattgtcccagctctgtgatcattgatcatttcaaattcgccattgtaaccatactttatcatcatggtgagaaactgcatcatgactttgaagcgtggcctgataagaacctggcattcaccactcttcagcattgttaatgttcttgagagtatctgccaggacattcatgtgcaccctatggtggcacagagagatggcagaaagagcccaaaagaaatattttaactcttagaaatgtatggtaatagaaactttatattgatagactttgttggttttgttttgttttgttttgttttaagattttatttccaaatgatctctgcacccaagcaggggctcaaatttacaacccagagatcaagagtcacatgttgtactgactgagccagccacgcatccctatagattttgtttttgcagacaggtaaaatatggcaatcaatcaaaatgttttgcatgtgtaaatttaggataaaatttaggtaatttgagagtgaaattggagaaaatttgaaaaacaatgcaaaatgtctgaatgtttatatttaagaaacagatgccaggtataaaatcttggacacatttttaaatgacataacagttttattattttttaagcactgatattgaccataaacttacatatatttaaacttaataatgatgatgtccttgtcaacttcaaaacacatggggagaattctgcttccaagagatagagtagatgtgttttttcctgttcctctcactaactacaactaatgtccacaccatggacattattacaaaacaagtataaggagactctgaaaggtggagaaaaagcagactgactagctacttcaggacccaaggtatcacgggatggtgaggtccccaagattcccctttgccttaagtatctcagactcaaagtccaaaaagccagcaacccagaaaccacagggaaaacagcgaacaggaacagccatggttggggggggagggggggagaggtgggggcagcctagcaaggcagaaaattttagacaattgctctactccagccaaaccccacaaaaaatctgactccacctgcaccagcaaaggccaattgagaagctttaacttccaatcctacaacacaacacacacacaccaggatgatgtcagtgaaaatgggtagggaacctgaatgttcatcccttcctggtggaaatagttccccagcctccaaccctcagtgttgatggagagtagacttctacacctcatcagacatctacccccatcacttcttcccggccccagcggtggtgggagagagtcaaaaaatgcctagtgcagagtcagggttctatcaagagggtaggatgtgatctaatatgactggtgtccttttataaggagaagagattaagacacaggcatacagagggaaggtcatgtgaagacacagagagaagacggccatctccaagccaaggagagaggtttcagaagagattgaccccactgacactttgatatcagacttccagctttcacaactgtgagaaaataaatttctgttgtgtaagccttacagtctatgttactttgttatgtcagcccaaggaaattaggtcctgtatttggccctaggcctaatccttattaaggaaggaatttttttttttaggattttatttatttattcatgagagacacagagagagagagagagagagaggcagacataggtggagggagaagcaagctccacacagggagccagatgtgggactcaatcccaggaccccgggatcctgacctgaaccaaaggcagatgctcaaccactgagccacccaggtgtcccttaaggaagaaatttctaagggaagactgtaacatataatttgattgtactgaggtttgggcacaattgaaggaaaatgaaaataggaaacccttgaattctgatggcaaagaatacggatgttagagaccatcggcccctacgaggattttccaactagaagcagaacaggagttgctgttgctaccaacacctgcccgaatttcttaggccctacccctgcactgcacactggctgggctcctactgctagcacttgcatctctttcctgaaggctttctccaaagctctggaggtcactgccccactcacagcaaactaaaagggacagggaattcatacaccaggaagcagttttcagtgtctagtggaagttagctcccccgttccccagttgggatgactctgaagcatgcagttcacatcatttcccagagttcccctacaggattcagctccagtcattcacacctcattggctgtcctcccttccttgtctaactcccccaaaatctgctattgaaatttccccacctccaaaataaactgctttcattcatgtccttgtctcaagaactgcctctggtacaaaccgaaataaggggtaaccctctcaggtctcgtccctctttgagagctttgtactacaattcaataaactttgctttgctgcccaccaaaaaataaaaaaataaaaatgaaaaacaaaaagagggcctgggtggctcagtcagtaaagctgtctacactcagctcaggtcaggatctcaaggtcatgatctcagggtcctgggatcgagccccagttggggctccctgctccctctccctctgctgttctctctctctcaaataaataaaatctttaaaagaaagaaaccaaagtaaggcactaggccgacttcttagcttcacagcagtacaagtcaacttctctctacccatggctcaagagtaattaactgtgactcttgattgtggtgcgtgggtctctagcaccctgtcactcaaaactccttattctttttgttgccagcacggatgacagcccagtctattgagtattaaataaagatagtttaaaaaaaaaaaaaaaaagatagtttagaaattgaattaattagaaatatttttattctcttctattcataataacagaaactacttgacgggatgagcgctgggtgttatgctatttgttggcaaattgaactccaataaaaaatatacaaaatagggcagccccggtggctcagcagtttagcgccaccttcggcccagggtgtgatcctggagaccccggatggagtcccacgttgggctccctggtggagcctgcttctccctctgcctgtgcctctgcctctgtgtgtgtgtgtgtgtgtgtgtgtgtgtgtctctcatgaataaataaaatcttttaaaaaaatactcaaaaaatatatatacaaaataataataataataataataataataacagaaactatacaccccctctgggcctgcccttgtattcccagattatctgagtgttggcgaccactgaccatctgtaacacagttttaaaggattatagggtatgaggcccccagactggcaccctctccttagcccacagattttgtgtcagctccaagtcaggaaaactggctcaagagtccttcacaaatctgtgatttatggcataagcactggcttaagacatttactaatcaaagcctgtctttcatcctgtctctaccatggttttcaaaaataaattttaaaatcaagagcttattcttttgatcataattgttctgctgtggtcacccaaggtataaaggggaaatgccttatctgtctctgaaagtagaaaaacaaaacaatcctcatttgatatcatagaatttctcctaccattatacctgtcttataccattctatatggtttgagcattttataacaagaaagagttctgatattttctatggaacttttttaaacaataagaaataggacttttttgtaaggaaggaatttccactaggtggtagtagagaatcaatatcagtctaacccaaaagaaatgttcattaagggcaaaaagaaatgttcattaagctgagaatcaaatgctgtagccatttgtagctacaagtgcttattaactagctcagtctaaggtttaatttcttcagaaatgccagatgatacatatcatgctcttttgagcaatgtttttctacttacggtctcctataacccacttttctgtaaactggcctgcatccatttatacagaacaattgaacaactggggtccactatggttggaacaatagaatttggagaggagacacactgataataaaaacacgtactcttttcccttaagtgaagtaaaattatagtaatatacgttggatctgcacacattcctctccttcagtctccctggataaaatgaggcaagtgtattctgaaaaaggagtaaccagaagtgggctccagtatccttaccctatcaacatgtttgaccagactgcatcaatgaccagttggtttgcccatttcttttattctagcacatcctcagttctgacctggccaataggtgtaagacctggatattctcacctgtgatatgctgaggccagatttgggttctcacaaccacctgtatcctcttgcagggacacttgaaatttgtggccagatccagctcattatggctggggaccactatgaccccacagacttatttcccttgggatctaaaatcttcctgtactgagtagcagtttaatcttgagtgtgttctactagaccctggttcatgaccccttgcaccgcatcctgtatcgccccctccttggcggtgccttatttcatttcctctgattctaactcatgccaattccaggagagacacagtctccttcatcactggtcggagttccaagcaaattgtgctggaaatccaatgggcgaaccagacctatttctaagttcaaagtctctgcctctgggtcacttaatcttgatcatttggttatttcatttcaatccttgaagcattgttgttactctttgctttcaaatgtggtgccctgcttgttcttgtgctcttttttttttttcagtccttggaccaagcaccatctttccagctttggcagaaagccaagtaaacttctctcactttggcaccctgagtccctgcctaagtaaactagataatgttaggtatttttatgttgtctacctagtggggttttttttttaatttttatttatttatgttagtcacagagagagagagagagaggcagagacacaggcagagggagaagcaggctccatgcaccgggagcccgatgtgggattcgaccccgggtctccaggatcgcgccctgggccaaaggcaggcgccaaaccactgcgccacccagggatccctacctagtggtttttaaatgtgatttcaaaagcagtttaattcaccattctttgataactatggtaaatatgcatattttagtatatttattggtcatctttcctctgatgtgaaatgcctattcacgtcttttaactatttttctctcggataattgttaaatattctggatataatcctatgtaaaatacgtgtgatgcaaataaatctagtctgtggcttttgggttttctttcttaaaaatatagtttgacaaaagtttctaattttaatgtggccagattcataaactttttcttttctttttatgtttcttttttaattctgtatagttaacatacagtgttatattagtttcgggtgtacaatataatgattcaacactcctatgtatcacccagtgctcatcatgacaagtgcactccttaatccacatcacctattttacccatcccctcacccacctcccctctggtcaccagtagtttgtagtttgtactctatagttaagagtctgtgtcttggtttctctctcttttttctcctttatttgttttgtttcttaaattccatatatgagtgaaatcatatggtatttgtctttctctgactgactttacttagcattataacatctagatccatccatgttgttgcaaaagacaagatttcattcttttttatggctgatccagtaccatattgaataaaagtggtgaaattggatatccttgttcccaatcttaggagtaaagctctcaggttttgttgttgttgtttgttgttgttgttgttttttaccattgagtatgatgttagctgtgggtttttcatatatggcctttattgtgttgaggtatgttccctctatccctattttgttgaggatttttatcatgaatggatgttgtactttgccaaatgctttttctgcatctactgaaatggtcatatgatttttatcctttctcttgttgatgtcatgtatcacattgattgatttgagaatattgaaccacacttggaacccagaaataaatcccacttggtcatggtgaactattcttttaatgtattattggattcagtttgctaatattttgttgaagaatttcacaccttactggcacaaaaacagacacatagatcaatggaacagaatagagaatccagaagtggaccctcaactttacggtcaactaatattcgacaaagcaggaaagactatccactggaaaaaggacagtctcttcaataaatggtgctgggaaaattggacatccacatgcagaagaatgaaactggaccattctcttgcaccatacacaaagataaacacaaaatggatgaaagatctaaatgtgagacaagaatccatccaaatcctagaggagaacactggcaacaccctttttgaacttggccacagtaccttcttgcaagatacatccatgaaggcaagagaaacaaaatcaaaaatgaactattgggacttcatcaagataagaagcttttgcacagtaaaagaaacagtccacaaaactaaaagacaacctacagaatgggagaagatttttgcaaatgacgtatcagataaagggctagtatccaagatctataaataacttattaaactcaacaccaaagaagcaaacaatccaatcatgaaatgggcaaaagacatgaagagaaatctcacagaggaagacatagacatggccaacatgcacatgagaaaatgctccgcatcactggccatcagggaaatacaaatcaaaaccacaatgagataccacctcataccagtgagaatggagaaaattaacaagacagaaacaacaaatgttggagaggatgcggagaaaggggaaccctcttgcactgttggtgggaatgtgaactggtgcagccactctggaaaactgtgtggaggttcctcaaagagttaaaaacagacctgccctaccacccagcaattgcactactgtggatttaccccaaagatacagatacagtcaaacaccgggacacctgcaccccgatgtttatagcagcaatgtccacagtagccaaactgtggaaggcgcctcggtgtccaccgaaagataaatggataaagaagatgtggtctatgtatacaatggaatattactcagccattagaaacgacaaatacccaccatttgctttgatgtgggtggaactggagggtattatgctgagtgaaataagtcagtcaaagaaggacaaacattatatgatctccttcatttggggaatataaaaaatagtgaaagggaataaaggggaaaggagaaaaaatgagtgggaaatatcagagagggtgacagaacatgagagactcctaactctgagaaacgaacaaagggtggtggaaagggaggaaggcgggatgtgggagtgactggatgacagacactgagggggggcacttgatgggatgagcacttggtgttatgctatatgttggcaaattgattgaactccaattaaaaaaaaaaaaagaatttcacactttgttcatcagagatgttggtctgtagttctctctttttttgtagtgtctttatctggttttggtaccagggtaatgctggtctcccagaatgaatttggaagctttctttcctcttctattttttggaatgttttgagaataggtattagctcttctttaaatatttggcagaattatcctatgaggccatctggtccaggacatttgttgggagcatttgattactgattccatttcattgctagtgatctgttcaaattttctatttctttctgattccgttttggtagtttatgtttctaaatggataaatttatccatttcttctaggttgttcaattagctggcaaacaatttttcataattctcttataatccctttgtatttctgtggtactggttttcatttctcttcttccatttctgattttgcttatttgagccctctcatttttttatgaatctggttggaggtttgtttatcaattttattgatcttttcaaagaatcacctctggtttcattaatctgttctattgtttgggttttttttttttttttttttttactttctatttcatttatttctggtctaatctttattatttctttccttccactggttttgggttttgtttgttgttctttctatagttccttcagatataaggttaggttatttatttgagatttttcttgcttcttttttttttttttttttttaatttttatttatttatgatagtcacagagagagagagaggcagagacacaggcagagggagaagcaggctccatgcaccgggagcccgacgtgggattcgatcccgggtctccaggatcgcgccctgggccaaaggcaggcgccaaaccgctgcgccacccagggatcccagatttttcttgcttcttgcgggttttctttctagcctgtattgctataaaattcccttccagaatagcttttactgcatcccaaagattttgggccattgtgttttcacttttgtttatgtccatgtattttttatttcctcttcgatttcttggttgcctcattcattgtttaggagcatgttatgtaaccaccatgtattcgcgttcttccaagactttttcttgtggttaagatgcatcatacaacttcagtcttttaatttgttgagacttgttttatggcctaacatgtgatatattctggaaatgctccatgtgcacttgaaaagactgtatatcctgctgttttaggatggaatgttctgaatatatgtgttagatccatctggtccagtgtgtcattcaaagccactattttcatgttgatttttctcttcagaggatctatccattgatgcaagtagtgtgttaaagccccctactattattgtattactaccaattatttcctttatgtttgtatttatgtatttctgtttttaaaaatttgtatgtgtcgtatgtaataatattaccccacttaaagtcatataagttatttcttttatatttcatctgaaacttttaatgttttttaaaaatattttagcacttcgttcatttggagtttatttttatgtatgatgaatgtatatccaattattccggtattgaatagtacatcttttacctaattatctttaatgcccactcactcttcacatctaagaagccctgatgccgttttccattctattctattggtccatttgtctacataccctgccaccatcagtagtgcagggtcttaatgacagtgtatcagtcttcagtagtatcttgcctttccttaaccttgtactacttcatttcaatttaaaatcagtttgtctaaattccataaaataccctggagagattcctctagaaattatattgaaactatagaacatattggggaaaactaacatctttataatattgaggctcttaaccatgattatggtgtatacaggacctcatcactatctttcagtgtttttaattttccccattaggatcttgcatgtcttttctttctgagaatttattcctggtgactttaagtattactatgttactctcaaaagggacattttatcgcatttcctactttgtttaattgaaaaacgcagttgacttttttgtggatctctttaaccaccttgctaaactctattattaattcttatgtcttagattattttgtattttctctgtagacaatcatatcacctatgaataatgaaagctttctttcttccttcttatgatcctaacttttcttcctttttacctattttcctttcttttcagctgttgttaaaagtcccctattccctgcctaagtagccctaatgtatcattttccattcatagtataaaattttactctctgacagggtctgcgttttttaacccaatgccaataatggaatttcagttcttagccttgaaatgccagtaacaacattctcagcaagataaaaagcaaaaaatgtttctttcttttccccaaagctgtggagaacaatgtatttttaacataaaactttcttataaatgatatttctaacaaggatgatttctcaaacccctagactccaaagattcggagtgagacctgataaaacgaccttaaccaataaaatacctgtaattttgattactcatcttttttaacaattcagtgttcttgtaataatgttgagttaacatctccatctagaggaaggtaaaattacttgtgatttttttttctgtcaaaccagaaaagaaacattggcatttccctgtactcacacagaatacagctgaatggttctattggaatttttattaaagcaaatgtgagagggcagcctgggtggctcagcggcttagcaccaccaccttcagcccagggcgcgatcctggagtcccgggatcaagtcccacgtcgggctccctgcgtggagcctgctcctccctctgcctgtgtctttgcccctctctctctctctctcatgaataaataaataaaataaaaaagaaaatgtgagagactgttgaataaaacaagcagagcagagatataaggaggttgattgcatgctgagcctaaaaatgagcccacaatttaaaaaaaaaatctaaagatttttaattttattttatttatttatttttttttttaagatttttaattttaaaaagccaaataagataaacctgtatttacgcttctgggttggtccaacagttcccccgcccccaccgcgcgacctctgattgacggccagccgagccaatcacagccagggcctcgggtgggcgggccgcggaggcgcttccgggggcctcgctggtccgggggcctcgctggtccgggggcctcgctggtccgggggcctcgctggtccgggggcctcgctggtccgggggcctcgctggtccgggggcctcgctggtccgggggcagcagcttctccgcggcgcggctggccctccctgaagtgcccgctccgggtgtggagacctggacggaagcggtcactgcggctggaaacccggggctccgtggcagacccctacggtgcagggtccctgagctcctgccgcgaggaagaggcccccagtggtcctgcaaatgcctgaagaacgcgcaggtgacgctgatgcaggggagattccggggacgtaacggtgtcccccaggcagcgcccagcgcggtagtacggaaggggtgcgcgcgtccaggtttctcctggtgggagtgtcccagtgctccgggctcgcgggatcagttgaaggaatccgggcccctggggagggtccctggagaatgctgagagtcctgcagttgttccttcggttctcgtcacgcttgttgggatatgtaactcgttcccttgagcctgaggtggcctgtggttgtgccacggccctcttctctctcacacgaccttctgggcctcacgccgcgtcctcagccgagctgcggtccggaggagggccaagtggggaaggaaatcccctcgcagaccgggaaccgggcactgcaggatgcctctagcgtgaccagggtccgggcctagacagaagagtaaaccacctcctcttgcgtctcaaagccgtcttcctactgcttccatcatcctgaatgctggcctgctggcccgcggtgctctggttattagagaggaatttgaataatgtagacgaaaaacttgagtgaaacagagtgaggataccaggcctcttcagcttgacttgtgggtttcccacactaactctgagcttaagagcaataccccgccactcttaagctagggtgacccacagatgtgctacagaggatggatgggagtatgccctcagcaaggcaagtccgcctggggccgagtgtggccaaggagccttggttgggggccattacatgcaaatgagttcctgctgcttgcatcagaggaggtgtggcaagagcctggtgaaggctcatcctgatgctcagcctgagatgcagtcaagatggagaactgcaaagtcagcagtacacgttttctgggagcctcaacgtccaatgacaggctccaccaggaatgagcagcccctgtgggctgagctctgcacgcctggcctgcattcggatgggctggggaagctgagccaggagctcggagagtgaccggaagggcacccaggcacctgagaaatgcttcctagatgtccgcttcaagaactctcttcatgcatttcccaaaattttcgtcagtgatccagtgggagaaaaccaggtcccagacttgattaaaaaacaaaacaaataaacatgatgcctgggtggctcagttggttaagcatggatccaaatagttgcaaagattataatttccagtacaccatagatattgacatatttaaataaaaatcaccttgtcaaagtgtctagtggaatctaattaccataatgttttgacacccatcattaatttttaaaatgcacaacctcttccttaacaattggaaattttacattgctctcttttttcttttaaattcatactctcattttcctccccctatagaattttttttttttttctcaatcctggcccagcatcttagtgtaatttattttggctcttggaactctcttcttgatccatctagcatgcttctttgcaataaaatatgttcttaaatttttgatttcctgatctaagtgattgaaaagtcagataaattcagatagtactataattcttagagataattgatcaaagtaatacaaataatagagattttggtaaataaaagtgttaaacatatacattttttaaaagtaaattttaactggaaatgcttctcttatagagatggataggggctttatttttccagcttcatgttgatgaaagttactgttattatgagaacaggttccatatgatttctattcctttaaagatattttaacataaagaactaaaaaatcttattcatggggtgcctgcatggctcagtggttgagcatctgcctctggctcaggtcatgattccggagtcctgggttcaagtcctgcatcgggctcccaagagggagcctgcttctctctctgcctatgtctctgcctctctctctgtatctttcatgaataaataaaatctattttaaaaagtaaaataaaaaaatcttattcacagaataagtataagaatggaaggaattttgttgtagcaacttttttttttaagattttatatatttattcatgagagacacaggctaagggagaagcaggcctctcctcggagagccagattcgggactcaatcctgggactccaggatcatggcctgcgtcaaaggcagacactctcaaccactgagccacccaggcgaccctgttgtagcaacttcatccagtttttaaaatttcttcttagttgtatgccaaaactcacacagtgagctattattaaatactgttataatctcacaactcaaatgtagagttctttttcaattttgttgaagcaaagaattaggaactacctgatttgcaaaactatttttacacattagtttctttgactttctcagttcttagaagtatataccagaaaggctttaaaaattcttgtgaaataactaatatctatacctgttagaggcatcttgtttgtgaaactcaaattggatggaactgggttttgaaagaactccacagatttgaaaattaaaaatcagtaggttctgaataaagatgttttcctcattttttgtcacctggaagtgcatttaaaaattatgataaagagggcagcctgggtggctcagtggtttagcaccgccttcggcccagggcatgatcctggagacccaagatcaagtcccacgttgggctccccacataaagcctgcttctccctctgcctgtgtctctgcctctgtgtgtgtgtgtgtgtgtgtgtgtgtgtgtgtgtcatgaataaatgagtaaaatcttaaaaaaaatatgacagagatgggcactaagctattgtgtatgtgtgtataatttcatttgactgtagaaaattattaattttgtaatcatgcatttgatagatatagaacaatgtatcaacatccatgagggagaaattaatccaaaataagtgaacctggatttctaaagttcagggcattacaatcaagactgcattttcgaagattttgttttgtatccacacataagtggatttctgcttttaagaacacaatttaatcttagaaactaacagcaaaacgaagagaaggtattagaccattactcagtttaagtttacagaaattgtatttctgattgctatgtgaattatttccaggagaattccacttcatcaaattatcttcaaatatcttcatcagattaacctgaatctagtgggtataaacaaataaatgagcaaagaagtgggacacctgggtggctcagtggttgaccgtctgcctttggctcagggcgtgatcccaagatcctggatagagtcccacattgggctccctgcggggagtctgcttctctctccctctgcctatgtctctgcccgtgtgtgtctcatgaataaataaataaaatgtttttttaaaaatgagcagagaagtaacagtatatcatagacctgtacctaaatagaaaaatatctttctatgatccggtaatatttggtaaaagtcaatagaaatatttctcctataagtcagaataagctcaagaaaacatatactaaagtactcccaatatgtgtttattttgctctaaaatatgatgttgatctgtcagaactaaatgttgagacttttgtattcactgctttcaaatcatgcaacaaaagcaagtgaagtacagatgagataacaactgaatacgtctttgttagttctgagaaaattctattgcaggttagtatttctttacatgatttttataagatgagaattttatttatttatttatttattttttttttagaaagaaagaaagaatgagagcatgtgagcagggggtgagggagagagaatcttaggcagactccacacccagttcgagccccaatgcaaggctccatctcatgaccctgagatcatggcctgagctgaaatcaagagtcagatgcttaaccagctgagccctgcaggtacccctaaattgagaatattctaatcctagaagagataaaggtttgaaccttgccatgaatttgtcacctgaatgaaatttaaaaaccaccatcatcaatatttcttgccaatgctaaggagccattaattctttaattagaaaaggatgtcttcccagagcctggtggctccctcagttaagcatctgccttcagctcaggtggagatcccacagtcctgggatgagcggtaccttagactctctgctcacagagagtctgcttctccttctccctctgcccctctccctgctcaaactctctctctcttactctctcttgctctctctctcaaataaataaaatcttaaaaaaaaagaaagaaagaaaaaaaagaaagaaagggaagtctcaggttatcagatgtaattttcagtattccaactcttcaactgaggaattatacaaatccagaatattgtaacacaggtctaaactcccccccccccccaattcttatgccacattatcacccttaatacgaagttacttgactgagagcatttttgacgtttggagttgaataaattcagtttttgctatcccgtgcattatagaatgtttagcagcatccccaacctctacccactagcatggattcccaactggaacccttcagtgatggcactaaaaaatatctgcagatattgtcagatgtctccccttggtggcaaaatggttgaggatcaatgcccttaacagaaatatagaacaacataaagctgtggttaaaggagacttcatggccaccagttttgaactgtcctcttctttggtactcagaagtattttattcccaggttaaagcaccataattatgtcttggataggtaagcagtatgcccttctcttgtaaagtgggagaaaaaagattgagtcctcgaagaacagtcgaaagcaaatcacttttattatttaaagaggcttaagacaacaggtgtttgattaagcacatcactttttcaagtgtatgcacatggatattggggtctagattcccttaaaacttctgtgctgatgtcccacttggaaaactttaatacccccaaaatacaaaaccccagtttgaagactactacatttgaggaccgttacaaacagagccacactgaataaagcagagcaaataagttctacataaaaggtagggaaaaagaaaaaaaaaaaaaaaaaaagaaagaaagaaagaaagaaagaaagaaaagaaagaagaaaggaaggaaggaaagaagaaagaaaggaaggaagaaagaaagaaaagaaaaaaagaaaaagaaaaagaaatacccattccctaaagtcagatcaattccatatctttaaacatttaggaagattttcaacacagattgcctcacatagcaaatggattcctcccttgatatgaaataaaatgtgaaaacaacctcaacatttagaaacctaagccttaaaaaaaaaaaaaaaagaaacctaaccctttcattaatttttcttttttttttcatgaatttttctaacagtccaatgagtatcatgagtgtagctttgaattcccatagaaaaatattagttgaatattaactagagtgaaatattttagtgtcttcagcagacagtgacacaagggctgttagaaatgtaaactcctctctttactgtttttgcaattgtctacccagtcatgagaattgtgaaaaacgttaacaaacatctgagagacgaaacacacgctcaagtgcagcaaccatttaggcagaagataccagaccaaggtcccaaagtcaattagagattttagaaacttaggttaatatcaaagaaaaatataatcaccattaatatcaaaattttgtctgctgggtccctgggtggttcagtcagttaggcatctgctgccttcagctcacttcatgatcccagggtcctgggattgagccctgggtcatccggctcagtagggaatctgcttctccctccccctcgggccctccccctgcttgtgctcattctctctctctctctctcttaaataaaatcttttttaaaagaatatgttgggacgccagggtggctcagtggttgagaatctgcctttggctcaggtcgtgatcccgtgatcccaggtttctgggatcaagtcccacatcgggcccctggtagggagcctgcttttccctctgcctatatttctgcctctctctgtgtctttaaacaaacaaacaaaaaaaacaatatgtctaagaaatgttataccttaacttctaccagatactataagtggggtaacatgaagattccatgtcatttgtgataccaaatatttaaattatatctctatttgagcacacatgactatatttacaaacgtctagacattaatttaagacataacaaagtctggtctataaggtaagtgaatgaaatttaggacattccatttaatgtagcatttgaatttgaaaagatgggagctgccaaaacttctaagtagcaagacacccttcagtgggtaaatgaataaacacattggtacattcacacagaggagtattatgcaattttttaaatgagctatcaaaccacagaaagacatggaagaaccttaaatacatattgctaagtgaaagaagtcatctgaaaaggctacctattgtgatcccaactatatgatattctgaaaaaagtaaaactggagacagtaaaaattagatggtcaaaagaccagtgatcaccaggggttcactgggaaagagggaagcagagttgaatagatggagctcagggtattttgggggcaatgaagctattctgtatgatactgaaatggtggatacatataattacacatttgtcaaaacccatagaatgtacaatgctacagactttacttaataatgtgacaacattggctcatcaattgtaacaaatataccaaaccaatgcaagatgttactaacagaggaatttaggagaaggtagggagtgaccgaacatatgaaaactatcatatttttccacccaatttttctgtaaacctgaaactcctctccccagaaagtatatttttaagaagaaaaaaaaagaaggcatggttttatgtggacaaaaacgctatgactgcacttttattttatacgtgatgaaatcagagaggggacataatttaaactcaacatgcacaaaacaatttaccataagaaagtgtttacccaggtcaggaatattaaataagcttagattaaaattaagttctcttgaatttactgagtaatcctctatatactagtttaaatttttagtgcagagagttttttttaagtttatttatttaaacgatctctacgcccaacatggggctcgaatttacaatcctgagatcaagagccacacgctcgcctgactgagccatccaggcgctccactgcaaggagatttttaatgtccttttatgaccactaattattggtctacagccaagttgcatatctgatctttattttataacttaccaaagacactgaggatattaaactagagttacattttcccatttttaatacaaagagtttttaggaacagaaagtatttctattttaaaaaaagaaagaaagaaaaaacgaaagaccattgtttgagcattcattattaaataagcatagttatttttatgtgagtctgtactttttcatcttgcttttgccatagtatacccgtttgaactaaggttttataatatgcatagactttttaaaatttgcaacttaatggcaactttcttgccatttgcaatgacctggatagagctaaagtgtattatgctaagagaaattagtcagagaacgacaaataccacatgatttcgctcatatgtggaatttaagaaacaaaagagatgaacacatgggaaaggggaaaaaggagagagagaaacaaaccataagaaactcttaaagatagagtagatggagggaggtgggcgggggatgggctccataggggatggggattaaggagggtacctgtagtaatgagaactgggcattttatttaagtgatgaaccactgaattctactcctgaaaccagtattgcactgtatgttaactaattcggatttaaataaaaatttgaagaatgaaaaaaaaagggaaggtaacctttccaactagaaaatcattaaaagattccatcttctgagcgctgatttctctaacttatttaacctaattgtgtaacttgaagatagaaatttttctctacagtctcgtgaaaacagaatgacagtggaatttaagttcacagatactgtactttgaccttatctcagcctggaatttttcttaaatgttaggaacatttaaagcattaggaaccttggttaatttcttttcttttcccctacgtatttgagactcctgtcttggattcatgtgagttaatagtgattcttggaatcaataaaaacaggagctccattgaacatgacagacaatggtttttattttctaatattgtccagatgaggacctcatcctaatttaaggacaccttccaaaggaggctcctttctttgacacctacagtgtagccataccaattctcaagacacaagcagcagactccaagtctttacatttcctaaagacatacaaattgatctgcgttttctctggtggaaactggatacctggtcaacttttcagggccttgtttttaagtcaagaaatgtgcagcctattctctttctccctgtcttggtttgcttcctgggtttacttgggttatccagctgacttgctgttgctgtaataacagggctgagcatgctatgttgagagccaccactgaaaaccagaagaagctattttttgaaaagcctatcagctgataagattcctttctgatcactcctcataatctctagctttttttttttttttttttttttctagtctagagcaaatctttaggagctgaccaggatccaaagctgttgtagcctaaattggctgtgatcttccccatacttgagagcgctgagctttaacatggaccttagccacctggaaggcctgctgtgaggggacaaagccagactcttgacccagcaggaatacatcaacctggtccagtgtagcaccctggaagatgtgaaaattcatttccagaccactgatcatggcaacttcttggcttatcctcttatggcttccaaaattgacaccaagatggagaaaaagctatgcagagaatttggatatttctggaatcatcccccagaaccctgagcacatttttttgcatacatgatgtgcagttacatgacaatgtgattctactgatgaacggtgcgttgccaaaaaaaaaaaaatctgtgcaagaaattctggtgaagtgccacctattaggctatttcacagaaatggaaacagtcaacattatggagacactttcctatccctttaatgctgttctggttgaaataccgttagctacattctttctggactatatgtctgaaaatactgtagataaactgaatattgaattactgcataatacgctgtacaaatcttaccttgaagcattctataaattctgtaaggatcatggtgatgtcacagcagaaattatgcatcccattcttgagtttgagggtaccagaggtgcttttatcatgacgtttaaccctttgtaaccgaactgagtaaagacgaccgagagaccctctacctgacctgtggcaagctctgtcctgagcaactatgccttctgctcaagcagaagactttgaccagatgaggtgagtagaggaccattacagactttacgggcctttgtttgagactgtggtcatggcactggaggaaagacattggaggatgtgttttatgactatgaggtacaaatgaaagtgctggcattcaacatgcaattccactatggcgtgattaacatatacacaaagctgaaggaacaagaaatgaaaaatattgtgtggatagcagaatgcttttcacaaagacattgaagtaatatgaacagttacattccaattttataaccagtgtagggcctcaaatgcagaaaatcataaatattaagaagagattttgaggaaaataaaaagaattgtgttatatgatatgggttatacaaaaataatccatactgcacctttgtgagttgcagaacccctggaaacagaaaaccaaccctgaaatggtgtttctttttttttccagcagccttaaattttgtttccacatttatgtctcattttttatcatatcttagatattaattctgattagccccatggtgctttttctattcttatgtggttgtattaaaaatcagatctaattttttaaaaagaaaaaagagaaatgtacaatttctgcaccaaaaacagctggagtgtgaggttctagatcctcttggatacctcactttccacttcacaatggacccatgtttttacacaggaagggggaaaaaatctatcaaataatggaagaaataactggcttcttgggaagactgaaaattatccagcaacctctttccaaggggaaaataatgcatatattagaaaagaaaacacaatcatatggcttcccaaagcttctcaaacaccaggcatcacccacctatgtgtcctccagagagcaacaggtgtactgtaaatcaggaaaagcaacgatctcaggctgcaagttctgcacattaatggctcccatacttcttcctatatcaatatgggaaaacggattttgccagacttcagttcacagaagcaagacacctcactagagtctataatgaagctaatttagatcacaaaacctagaggtaggtaacaatttagcttgaaattttccagcaaccagctcagaaaggtgttgaaaagtggctatcctataaaacaaattcaaagaataattgatatgatacccagaccagaaaatttctcaagttcctatttttaaaagtgagcctctcaacaattctgttttaggaagtctaataggggtttcacaggtctgtcttttatgggattgttcagtataggtaaatattagagtctctaggtggttcagtctgttaagtggctgccttccactcaggtcatgaatcctggagttctggaatcgagccctgtgtggggctccctgttcagctctctccctcccccactcatgctctctccccctctctctcaaataaataaataaaatcttttttttttaaggttttatctatttactcatgagagacacagagatagaggcagagacacaggcagagagagaagcaggctccctgcagggaacccaatacgggactcgatcccaagatcccaggatcatgccctgagccaaagggagacactcaaccaactgagccacccaggcaccgcacaaataaaatctttaaaatatgtcggtgggatccctgggtggtgcagcggtttggcgcctgcctttggcccagggcgcgatcctggagacccgggatcgaatcccacgtcaggctcccagtgcatggagcctgcttctccctctgcctgtgtctctgcctctctctctctctcactgtgtgcctatcataaataaataaaagttaaaaaaaaaaaaagtaaaatatatgtcggtaaacagcatcaaaccaaaagataattctgtaacaagaattctacagagagccaacccattatagaaggataagtacagcaatagaaaaaaatacaaagtaacccagaaaaataaagtgactaactcttactgctatgaagcaggtcaagaaaagtttcctggggaaggaattttgatagatgtaacttggaattttccaagtaagctgtagaaggggaacattccaggcagaagaaaccacaaaaaagtaaaggcaggcaatcatgaatcagcatttttttcatagagatctatatctataatcagattaactgggggaaaacgtgaagtggggagacacaggagaggtaggtagtagcaagatccagaaatgccttctatactgtgttagagatttgatatttattttaaaataagtaaaattaacaaagttctaaatgaggactttagaaataatagtaatgaagctgagagaatatacttaaggctgtctgggaggtggaatttacaattaagtattgagtaataaaataagtgaaagggtccatggggaggtaagaatgtgagtctaaagtttctgattcaggggataaatgacaggaaatcattgaaatccattggcctatcttgcactttaaaaggttttttttgcccatacatgtttctgcaacaatcatgcattggccattagagaagagcaattcactgaattatgcgggtatttgaaatgtcagcacactttatacactatctttttaaatcacattcattaatattgcctctgacttcatcagaaaagtttttaagtacgccacggtagcaggtacaagcttcccaaaattctaattttcactcaaaagtttaaattttatcattggtagcagatataatgagctgtttttttgaagtgacagtctcactttgttcatattcaagaaaatgtctcccatatacccaagtctgaataaccaattttctgtcagttgtttgtttttccaaatgaaaaaaaaaaaaaatgtgttccataaaaaaagtagctaattcagcttgcaactcaaagttttctctggagacaaccaccatattttagtatatagcagaagagcttgatgggtatttcttatttcatcacagaatatttcttaaaatgtactcagagttgagatttaatagaagtgataattatttttccttcatcaagaacattctctagtgaaactgacttttaaaaactgtgggtgtgtcataataaagaatataatgagtgctaaagcaatttgatgctcttatcttgattcatgccaaggcactggtagtattatccaccattgttcttacactgtcagtacacatatgaatacaggtgttgcaggaaaaaccatgagggtcaaaaaaggttgtacaacactgttaatgatttaccacccctgtgtctattgtcaagattcacataaaaaaaggtcaatgattagttagcaatgataccaaatgagtacaagccggacagcatgtctagacacatctatagatcggttcatttatgtttgcagttaaatcattaacttgacaggttactctatcattggaaaatggtagtactatgctttcttatactgtcttttaatcaggcaggcatttgtgaaacaatgcaactgttcaaggctttattagtctctttactattatgtaagctcctctagccaatgtaatgttatcctgtaagaggcttttacagagtttgaaacatctacatttaaaacatttaagtccctgcccaggtaagccttggactcttgatttaagctcaggacatgatctcagggtcttgagatcaggccctgtgtccagctacatactgggcatggaacctacttaagattctctctctaccccaccccaccctccaccacatgcaagctctctctctctctctgtctcaaaaaagaaaaatatcctctgatatatttttaagccatccttaagtccaagaaaatgtattataaatatattttgttttattttagaataaaatattcaattctaaaataataaatttcatacaaaattttgaaaattaaaaatggttttggaaaatattttaatattgttgcaaaacaagatgaaattaattctcatgtttatgtataggtgcaggaaaatctttgagatttaatagttatgatttcctggaagataatgacattacagagtatagctgatgtaactgaaaagagctggttggagcaaggagtagtgagaacaaattgagttaattttttaaaaaatatatgtatttatatcctaaactcactaccttagaaaatccttgaaagtacagtacacaatttattaactgttagaacaatgatgtcatcccatgcctttgggaaacgctactgttcactcatgagagtgaaagtgaaaaagacaaaaaacatctttgtattataaatagttttaaccttgtggaccttataaaagaatctcaggaatctctcctccccagagatcctctagccataatttgagaactactgcacaagtcagttaatggtgctaagaaaattggctatgtccacaggaggcaaaaatcagaagccaatttcacaccatacaaaaataaatttcaaatgaattaaaggtctaaatgtgaataagtaaagctgttggaagaaaatatagaagaatatctctttattatctcagtgtagatagtctgacaacagcaagtgctgatggagagatggggagaaattagaatttgcatacactcgtggtggaaaatttaagtagttttcctgcttatttcaaccacttatttcacatatgcaatactgaataaattttaagggtatgaatatcctatatcccaacaattgtacttcagtttatatgacccagagccttagaaaatctctcatctatgtgcacaaggaaatatgcataaggatgttcattgcagccttgtttatatttagtagtcagaggatatccatcagtggctaaacaagtgaataaaattgtgttgtattcatacaatataaatttcacaaccattaaaataaactaaatgtacatatatcatgaagacaagtctcaaaatgtaatgaagactgatttgcactcattttattttattttaattttgtatttatttatgatagtctgagagagagagagagagaggcagagggagaagcagactccatgcactgggagcccgatgtgggattcgatcccgggtctccaggatcgcgccctgggccaaaggcaggcgccaaaccgctgcgccacccagggatccctttgcactcattttaaaccagtaattgcattgaggagagaaaaaaaaggtagcactgaagtcaggtggaaacaacacaactgtgtttgggtagtaggtgcattggtattgttccccatatattctgtatttgaagtgtttaatgttaattataacaacataaaatgtaccccaggtcctttgtgctgtcaattacagagtatctgcttctcttatcaaactttttattcttataattgctttacaggtaataaaataagttttaaattaattctgtctagttgtaacataatcaggtttgttaattatgtctagttctttgggcaataacaattgactttgtttcagtgcttagtattttttaaaattcattagtttgctcatctctttgatttttattttaatgtaccttaatcatgacctattttaaacataaagattaatggatatccattgcccaagcacccaactttattaaatcttaatattgtgccttgtttcaaatctattttttaagatgttaatgtctataatatagttgatgtctctggacccttccatttctttttttcctttgccagatatgacgacccagcatgaagtcaattttatcattactatgcatgttttaatacttccactaaatatttgtgaatccttagacattataaagtattgttttatatagagttttaagttttataaattgatatctatgtgtattctacagccgtttttgttgttgttgttgttgttaacatattttttagtcttatgtaggttgatcagtgtagttcaggtttatccacttaaagtgctgtagtgtgtactattgtatgagtatgccacaacttattaatccattccaatcgtaatggactttaggttggtttctggattgtggtttgagtgtgtgtttgtcttgctttggcttggtctcacttgtttttgctacaatagacatttatgtacatgtcgatttgggtataagagttttattaggttaagttttgttaaacatttttcttaaatttcaaggataatttagaagctagtattatcaacagcaaagaaacatttatctggattttggcaattctttagtgccattccttttttcttcccgtttgagtaacaaacttttatcccatttacttccatatctatatatccatccctcatttcacctaggaattgggagatgcctggaataatagtcaccttttcaagtaataatagtaacaatttaacaatagttgtttctgagtggaagaattcaaggggagtatttcctcttatcttgatacttaccctgtgttgcttgaatttttagttaacaggcaggtatcactttttaataaaaatagtacattatttcaaaaactaaatccatgagtctgagttagagtaagtgatatggtagctgggctgaactcctaagttgtggcaaaaatgagggagctgaaaattcaaaaggatagaggaaaggtaggaattttctggaccctgaaatcaatggctattgccacacttctctaaaagttctatgtgaatatataggaaaagaaccctgggaactttggtaactgctccagagagaggcttgttgttttatgaaaacctgtaataactccttatggaaaagaataatcacatatcatttgctatgtattggaataacttcctctacatagtggtgtggtcttgcgcaagccttttctagtttgtctaagctctagctttctttatctatgataggatatgagactatatctgaggtgacttccatatgtaaatctgcattgaaccattctactcagataccccattggtttgcttaaaggataattttgtccattattaaaagcgttgtttcaccaaaatagtaatttactgaatattcattggttttaactttattaactttagtaaatggttcatcacagagttcctttaaatgctaagattttcgagtattatttcaaccattcggaagacatttttgaatatccaccatgaatctgatgctatttgagttgccagagatacaagaatgagcaagacagatgcagtctctttatcacaaagcttatagttgaatgcatcttatttaaaatatgattcaagcgccccgccccgtggctcagcggtttagcgccgcctccaccccagggcgtgatcctggagacccagaattgagtcccacatcaggctccccgcatggagcctgcttcttcttatgcctgtgtctctctctgcctctctctctctctctctctctcgaataaataaataaaatctaaaataaataaataaatatgattcaagactttaaggaacacagccaatccataaatcaataaagagaaaaatttccaatatcatgtcattgacaaacagagatgaatgtatatatatttaaattttaaaacttttttttaaagtagacggaggtagggggtttggggggggtggggggtggggataagcatagtaaaatccttaaattattttttttaatccttaaattaaaaaaaaaaatcattggcaaattttagcccatagatgtcagcaaagacccacctgtgggcaagaaaacattttgccagaggatgtagtgtttaaatttgtcttatgtttctttcccttctgttatattcatttttgtgttctctgtaactttttttttaagattttatttatttatttgacagagagaaagagagcacaagcagggagagtggcagagggagagagagaagcccccctcagctccccactgagcagggagcccaatgagatgcaaagctggatcagaaggtagatagatgcttaactgactgagccacccaggcaccctgccctattctctgtatcttaatagcctatagcatgtacccaaagcaatgtttcctattatttcatctatttattgaaaatatatcattttcttaatttcattcaattaatttactagttctggtaatctaggtttgctcttctctctactttaaaggaccttttgtctgtaatataaaacctagtgcttgattgtatacaggcacaaattgttttctgaaacattggtttccaaaatggagtatgcacactacagtgaatgcacacaaaatccttcagagtatgaaaaggaaatattaggatttctatttatatatatttggcaacttttaagctttctatttgtgtatgttatggtatgtataatcaagtcatattactagtacatacggataagttatgataatttataaataaacatatggatataagtaccaaaatattttttactgagagagcagtcttaatccatttgggttgctataacaaaatatcagagactgggtagcctatgaacaacagaaatttatttcccattgttctggagactgagaagttcaagatcagggtaccaacatggtttcattccagtgaaagccctcttcctggttaatagccagcaccttcttactgtgccctgaaatggtgcaagggccgagagaattctgggaaggcgtctttcacaagaacactcattcaggagggctacatcctcatgacctaagcacctcccaagggcctcacttcttaatacaatcacatcaggcaaaaggatttcaaggtgtgaatttgggaagacacacacttatagaccataggaagggctttatgcttaaaaaacaatgtgaacaccatagtgcaaatgtgtgttttgtcttgcctacataatcggagtgtgggttcttccagcgagtgatggtgtcttctcttaccttttccaagggaccttgtgcatgtaaatgctaatatttatgggactccattgacatacaattcagttcttcaaaccatcagtctgaggaccatcctctgaacatgctttggaagcattttcattaaagctaaggctatcttagaaaatgttaattaaaaattaaaacgaggacacctgggtggctctgggatcaagtcctgcatcgggcttcctacaaggagcctgcttctccctctgcctgtatctttgcctctttctctcagtctgtgcctctcatgaataaataaataaatatttaaaaaaataaaaattaaaacgaaaagtataacaaagacattttcctttgtaccagcagaaagaagacttaacgaaaaacttcattagtaaaggtagaagtcatactgtaagatagcagggcacctgggaaggatttaagcggtgccagcagccttaaatcaaagaatgtctggttgcccaattaattcacgtttggtgtaattttttgttgataagaataactcataacgaacccaaccagcttacctttgatttttacacctcggtgtacaaaggaatttctaggatatagcttaggtgcaaattcagtctcacccccagggattctgagtcagcaggtcagagggtccagcattttcatcaagtaccccagaagactctaagctggttatcagagacgccacttcaaggaaatgtcctagacaagcgcattcttccttctcaaccagccatgagaatttgattaaaaaaaaaaaaaaaaaaaaacagatctaaggggctcctgggtgccagctaagcatccaaccattgatctcagctcaggtcttgatctcagggtcatgaattcaagccccacatggaatcaaaaaaaaaaaaataagcagatctaagaattcatttagcagtctgttactctcaccacctcttattgccaactatgatcagaagcatgaaacagtatttgttcttctttcagaggttatcacattgctggctgtgagatggtccagatccctcgggactgggcatggcctatgatcctggcaccccaaggccaatcgctgttccttcgtgtgtcagctgggcattttatgatatttacttaataaatcattactcagtcctgagcctcctttccttctgacccaattcatgtggtatggttgatccattaggtagcccatcttctggctttcctgttttcccaatggatgtggacaaaggaaatcctggagcagagtgagatgcctctctgtgaaaatagcagactctcctctcctaagatctttaataaaacatgccccaaaagcccttcccctatatttcccctttcagtgaattaaaccactctccacctattgtccaaaccagaaacctaagtccaatcagttttcaagtcccatcaagtcttttgctttgagtcatttcattgatttttatctcctttgcttctaattgtaatggtatacatgagtactaagtaggaggttcaaaattggagagatgggatttgaatgaatgtttttgtatgtataataaaagccatgatagatagaggagagaagatagagggaaagtaggacaaagtaaaaaaaatgtccatgaaagcacctcggaaaattcaaagcattacacaaatgtaacattttattattaaccatgatttcatttttgttccaattctgtccagagaaatttggatgctgtaaaagaattttaaggctttggtcaaaaaacactctatggtcttctaattactacttgtttatttataataacatttcaacaacaaagtaaaagttattttatagaaaaaaaacctgcaatgcccaccctgtataactcagctatggtgttgggttcaaattaatatgcacactcaaaaagccatatgagggcagcccgagtggctcagcggtttagcgccgccttcagcgccgggcctgatcctggagacccgggatcgagtcccatgtcgggctccccgtatggagcctgcttctccctctgcctgtgtctctgcctctctctctctgtgtctctcatgaataaaaaaaaaaaaaaaaaaaaagccatagtgaatactagaccagaacttagaagggtataggacataaaacaacattcttgtttatcagcctgatagcattaaacatgtcttctcaggagtctttacaataatctaggtattgattattgtccccattttgtgtggacatgcttggctgtaacagacaaaaccacaggggtggataggacccatcccaggatagaaaatcctcacaaattacaggaaccacatcgtataagcctgtgaattcacattcaagccagcaagcacattcagtttcaagaaacaccatacacagaatccaaggtctgtgtttcctgacaggtttttatactttttttgtcacataagcccacaaatttaatgcctactccatcttcctcatgcagatatagttcaccaaaaggggtcatttctacatttaaaagtgttgctttgtaacacaattgacattccttgtttatctaaacccaagacattccaaagaaacagtaaagataagataaactcgagttcatcttcctgtgggagaaaaaaaactggtctaatattgctattaacccttgggccccccaacaaacctggtttgttccccctcaaaagcttattccagtgaaggcacttcctggtagcagctcctgagcaagcagggggaagaaatgaaatgggtgcccaaacagggaaaaacctatcttttttaaccttcagatacaaagaacacaatgaattcaacatgtatttgatgtagatcttgtgccaaacattgccacagaggaagattcatctgcatccaagataaactgaggagaagaatgggagcagaggccaatgggaagataggaagccacaggaccagctagagatggctgcagcaaattgcttggagggctctgatatgtgctagggagacttaaaagagctaagttgaaagaattcataaattctacagacgcttctaagttacagaaaaggaagacacagccaaatacatcttaaagaccacgaggctaataccatctatcagggtgctgtcgcctcatcatacagcttccctcaaaactaaccagtatcttcctagaaaggaattgctgaaagtctttgtcctgaattctgcaaagtaaaacatccctgaagatgcacccagaaagggctcaatggagtacacagtcagtgctcaaacacaaatatatctctctcctacttgatgccacacacactcttacctcatgaatctccacatctcctttctctcctgccactggagcagagacaaatcagaattcccactcaccagcccatctggcaccaggaagagagattcttggcacaggcatgacagcacacaagtcctggccacaggtgtaagactctggtgatcaggaagcttctgactgccagccattggacgtcacctgtcactttgagagccagaaatgaaacttctatttcctactgagatggcaaataaataggctcaggctctccctcacccaaaattaattttgctaaagctatagaagcaaagggaagcaagcatttggagaaccagaaacaatggccacaacaaatataaaatgtttagaacttgccaagaaagagagaactgccatcttgaaactgtgcgtgtagggagtggggagggctgcattcagggatagaaacagcattaggaggacagactgcaggaagatctaaattttagaatattttaaattcaactcttatctccttcataattgtcttgagacatcactgcctcccctttacacataaacagaaattagagcagcacctgtgccttgctaagtcaaggaactaaagaaaataggtgttagcctggggtattcacttcttcattatttgctaccatggccccagctcccagagagcctgcctgttcccagttgtgcgatcccttagaactgactagtagagcgtctgcaaccatggagagtcagtgtttctgagttctctgccaggactggatctggaaggacacagaccttcatggtcagaccttcatcctttccccactatacatcgaccatacaaactagctgttatccccatggagacataagctcagagaccaacagaattagaccgctaaggactaaacccgctataaaacagaaataaatcaaacaccatatactgcctaatgcagaagtgagaaaaagatgaaacaagaacttaaaattagatggtaaatacaccagcgcctgggtggctcagttggtaagcatctggctcttgatttcagctcaggtcacaatctgagggtcatgagtttgagccctcgacaggctcagtgcagagtcagcttgagattctctctctccgcccccctactcatgtgcacaataaacaaacaaacaaataatcattgggggcacctgggtgactcagtcagttaagcatttacctttggttcaggtcatgatctccagatcccgggattgagccccacgacaggcttcctgcgttagtggggagtctatttcttcctctgcctcttctccatccctcctgctcttgcacacacactctctccctctctctgtctcaaataaataaaatcttttttaaaaaagtaaaataaataggggtacctgggtggctcagtggttgagcgtctgccttcagttcaggtcatgatccaggagtcccaggatggagtcccacatcagctccccacagggagcctgcttctccatctgcgtatgtctctgcctctctctgtatgtctctcatgaataaataacatatttaaaaaaaagtaaaataaataattttaaaaaaataaagaagtgtgtgtgtgtctgtgtgtgtgtgtgtgtccagattttaaaatcttcacttggttgtaggattggtatttgggtgagagaaggaaaaaaatcaaaaagacatggctcagcggtttagtgccgccttcggcctagggcctgatcctggggacccaggattgagtcccagtcaggctccctgcatggagccggcttctccctctttctgtgtctctgcctctctgtgtctctcatgaataaataaataaaatctttaaaaaaaaaaaaaaggacatgtaatggatgtgttaaccaatttgattgtggtaaacattttgctatgtatacatatattaaatcatcacattgtacaggtttttatttttttaagcaggctccacacccaatgtggagcccaacatgaggcttgaactcacgaccctgagatcaagacctgagctgagatcaagagacagaggttcaaataactgagccactcaggacccttatactgtatagtttttttaaagttacacactgtaaggggcatctgggtggctcagtctattgaacatctgactcttaggctcaggtcatgacctcagggtcatgagatcaagcctgacatccagctccatgcagaaagtggagtctacctgagattctctctgttcctctccctttccctctgcccctctcccttgctcattcactcaaatgctctctataaaataaataaataaagtctttttaaaaatattacactgtgcagcttaaatatatgtgatctttatttgtcaatcatatctccataaagctggaagaaaattttaaaaataaatgcattaaaagagaaaatcagaaggacatagagtatgctaaagaatctggagtcggggcagccctgatggctaagtggtttagtgccactttcagcccagggcctgatactagagtcccaggattgagtcccacatggggctccctgcttggagcctgcttctccctctgcctgtgtctctgcctctctctctctctctctgtctctcataaataaataaataaaatctttaaaaaaaaagaatttggggtcaatacataaatattaagatatttaagaaatttataaaggcaagtaaacatgaatatatgtcttaaattaaagccaaccatcataagaactgaatcagtaaatgtaacttccaatctagcaggaaaaaaatcagtctatcaaatggaaagtgagaaaaagaaggaaacaatatacattaaatacaaactctgaaatgagttataaaaataagtctcaatatatcagcagttataagaagaataaactatatatatatttaaaaaaaagaacaaactacgagtcatttaaataaatgcacttaaagtgggaagatatgtaaaggttgaaattaacaggaggaaaagatttaccaggtggcaaatatgacctcaaaaaagttgggcaacaatctcaatacacaacaaaatacatttcaaggttttaaaaaagtgctttgataaaggaccaaaaaaagattcttatataattaaaaagaaacaaggaacagtaatcataaatgtatataaaataaaaaatacagcctccaatttatatagcaataactgaaagaactacaagcagaattgatttttttaattgcagtggtaattttaacaaacccatgtcaaaaacggatatatagaaaaataagcaaatatcttaaagaccagaacaatacaagtatttaagctcagttattaatcaagccttaacaaataagaaaatgaattcttccagattacaaatgactaaagtaacaaaacaagtggctggaatgattctggattgcagggcaggaagcaaagggagcagggaaactatgaggatctttactgagaaagttactgaaatttgaatatgtattgtggctgagaatcgtattatatcaaagtttaatttccagggtgttaccattctcctctatttatacaaaagaatgtccttgctaagagcaagaaacacactgaaatacttaacaggagaggggtttgatgtctgctactctgaaataattagaacaaaacattagagaaacagaaacagaaaaaaagacagcaaacatagaaaaatattaaaaattactgaatctagacaaagtgtcataggaatttttttgtactattcttataatttttcgtaaatttgaaatcactgcaaaattaaaagttttaaattttcataaacagcgtttgaattaaaaccaaaattataaagaacataataattagaactgaccagaaattaaaacactagctatcaaaatttgttagatacaattaaggcagaacttaaaggaaaactttttacctgtaaatatacttttcaggaaacaaacaaacaaaaaaacctacgtaataaaattacctaagcattcaattcaaaatttaggtaaagaggaatagaacaaacccaaagaaaggaggaaggaaataataacgttaagaatagagataacaaaattgagagctaaaggcaattaatggaaacagaagcttgcctttgaatatatatatatatatatatatatatatatacacacatatgaaaagatacatatatctttatatatacatatatatatatatatgttgtatgtgtgtgtatatatatatgttgttctggaaaagagaatgaaaaacaaaagctgcccaactattgtataaaggaatttttattacaagaataaataaggaaatacaagaaaatgtccatgcttttataaaagtaaacacaacaccctaagtaagatattaactaaacaaaaccaacagtaaatacataactataggataatcaaatagggtttattataggaatgcaaagataagtttcacataaaaaaaaatctctctcagtgtaatccccatattaggatattaagagagaaatgtatgtataatgtaacaaatcaatgatgaaaaatgattttttaaatttcataatctacttatgatttttttataaaataaactcttagacaactaggaataaaaaaaattatttaacttaatttagtaaaggttgtacataaaaacctacagtgaggatttctgggaagatggagtagacctatttctccctattcctctcactaagtacaactaaaaaccctggacattatatataacacaaacataagaagactctgaaaggtagagataagaaggcagaccatatgggacacaggacctggaggaacgacacaatggtgagcaatttgggctttctttttcctgatacatcccaaacttggagctgaagaaactaacaacttggaaaggccaactggcataaaacaaagaaacaaaaagtcccaaaagcctgatatgactagcccaaaggctgatatcactagccaacagtctaattatcactagtcaaacatctgatatcactagccaaagaccaggacagaggcaacctatcaagaccagaaacttttacaaaataaactgctctgttccaggcaaacaccgtagaaataactatggccccattcctattcacaccagaaaggcagaatgggatacctaggcttccacccttctaagactataacagggcaccaaacatcaccctgcagtagtatccaaaaaaatcagttggacaccaagaattcatttcttcagaccagtaatgagggactctccccaatacgttagaggaatggactgtaggaggagaactcttacccctgtccaacaatgatgagaatggccaaagttctccaaacacaatgaaaattataaaagaggaatcttgaaacattgagaaacaagaacaagataagcaaaatatatgggtaaatacaataaatcttctcctcttgagttttctaagttacattagatgaagcaaaaattataacagtctgatatggttctaaatgtgtgtacaggaaatatttaagacaattatactacatatgagggaggagagaggtaaggcttctacactccactcaaactggtaaatgatgacacgagtagacaacagctaatgtatgcataatgtaatacctagagcagccactaaaaaatgttatacaaagagatacgctcaaaatgactgtagaggggcagcctggtggctcagtggtttagcaccaccttcagcccagggcctgatcctggagacccgggattgagccccatgtggagcccctgcgtggagtctgcttctccctctgcctgtgtctctgcctctctctgtgtgtctctcatgaataaataaatctttaaaaatttattttaaaaaaacactgtagataaataaaaatggaattataaagtgttcaaataagccacagaaaagcagaaaaaaataaacagaaatgacacagagagaataagtagaaaacaaaaaattaagtggcagaattaagccctagcatattgctatgaattgaattatgtccctaaagtcatacaccgaagccctaacccccaatgtatttggagatagggcctttgtggaaataattagggcaaatgagtttgtagagtagagccctgatctcataagattagtgcccttataagaagaaatatcaggcagcttattcttgttctctctcccactctccctcttgcatatgaaataaaaccagaaggcagccatatgcaagccaggaagagagaacgcttaccaatcatgctagcactctaatctcagacttccagactccagaaatataagaaaataaatttcttttgtttaagccaccgagtctagagtattttgttatggcagcccaagtaaatgaatatacatatcaacaattatattaaatgcaaatggtgtaaaattgtcaattaaaggcaaaaattggtagagtggatttttaaaaagtgagccaaagataaaatatctaaaaaacaacaacaaaaaacccaactcagttcaattcaaatatatgcaagttaaaagtaaaaggatagaaaaaatatattattcaatcattaatcaaagggaaacaagtgagcatactacttccagataaaataaactctagatgaaagaaaattaaccaagaccgtttgggacattttatgataaaagggtcaacctaccaagaagacaaaataatcctaaatgcttacacgtaaaaaactgtgcaagctgtaaaatatgtgaagcaaaaacataaaatccacagttatagggacatctgagtggctcagtcagttacgccactgactctgatttcagctcaggtcatgatctcagggtcctggaattgagcctcgcattgggctccctgctcagcaagaagtctgcttctctctgcccttcagcacctctccccactagtgctctctctctctttgtctgtctctctttcaaataagtgaataaaatctttaacaacaaaaaagtagtaataaaataaaataaatcaaagcctatgaaacataggtaaagcagtgttgaagagaagttatagcatgaaaagcatatattttttaaaaggaaaagcctccaatcaataatctaaagctcatacctcaagaatctagaaaaagatcaaagccaaagcaagcagaagaaaggaaataataaagatgaaagcacaattcaatgaaattgaaaacagggggcacctgggtggctcatttgcctttggctcaggtcatgatctcaggtcctgggatagagccccaagttggactccctgcccagcaggggtctgtttctccctctgctcctgcacccttgctcatgctctctctctcactgtatctatctcaactaaatacataaaatcttttttaaaaaatgaaattgaaaacagaaaaacaataatgaaattcaatgaaacaacagattctttgaagagatcaactaattgaaattctggcaagaccaacaaggaaagagaagatagaaatcactgataacagtaatgaaacagggaatgtcaatacagactctgcagataccaaaaagataataagggaatactacaaacaactctataaatataaatttgagaatttaaacaaaatggatcagtctctcaaaaaagacaaactattacaacttacccaataggaaacaggtcatttgaatagccctatatattgagtttggaatttgaaatttaaattcccgaaaagggaaactctgggcccagatggtttcatctggagaattctaccaaacatctaaagaagaattgacagaaattctatacagtctcttacagaagaggaggaaacactttccaatttgtgttatgaaactattaccctaatatcaaaaccaaatggaaaagaaaactgcatacctatatcctgcatcaatataaccacaaaatccttaacaaattatcagtaaatatgattcaggaatatgtataaaaaaacagtaaacactacaattattgaggtttttccaaggatgtgaagctggttcaaaatattcaaaaatcaatcaatgcattctatcatattatcaggctaaagaagaaaaattatcaaatcaacataattatatcaatcaatgcaggaaaagcatttgattaaatttaatgcccattcataacaaaaacccaggaaaagaatgggaataaagctaacattctcaaagtgttttttcaaaaaagagaaaaaaaaatgaaaaaggcctacagctaacattatacttaatagcaaaatactgaatgtttttcctgtcagacagggacaaggcaagatatccactctcaccactcttatttaagatggtgttagaagttctagccagtaaataatgcaagaaaagaaaaatgtaatcacattggagaaggagaacagaagcggcagcagctcaacctaagatggattatggacttaaatgtaaacgataattttttttaaataggggaaatcttcaggatgtagagctaggcaaaaaattcttagagttgacaacaaaagcatgattaataaacagaaatattaataaactgcacctcatcaaaattagaaacatttgctctgtgaaaaacctataaagaggatgaaaagacaagctacatgatggaaggaaatatttgcaaaccatgtgtccaaaacagaatcagtatctagaatatacaacaaattgaaaattcaacaggaaaaagcaaacactctaattagaaaataggaagaaatgaagagacatttcacagagtaggatacacacatggcaagtaagcacatgaaacaatgttcaacaatagccattaaggaaatgcaaattagaattgcatttgagatattgaaattgaaattgagatatcaccacacacctgttaaaatggctaaaataaaaaaacagtggcaataccaaatgctggcaaggatgtggaaaaactggattgctcatacattgctggtatagccacttgggaaaacactttcgtagtttctttaaacattcaactcctgaatgattcagcaattacaccactgggcatttatcttagaggaatgaagacttatgtctacacgaaaacctatacataaatgtttagagcagatttattcatattatctaaatactggaaacaatccaaatatccttcaaccaactgtgttatatccataccctggaatacaattcagaaataagaaactgtatatttgcaacaaccttgtataatctgtagagaaatatgttgagagaaaaaaaaccaatcccaaaatgttatatactgtatgttttcatttataaaacatttttaaaatgacaaaatacagaaatagagaacagattagcaactgccagaggttaaggaagttgtggggcaatagggaagtgggtgtggctctaaaagagcaatatgagggatccttgtgatgatagaaatgttctgtattttaactgtatcggtgtatcccaattgctatattgtaccaatgctttacaagatgtcatcatcagaggaaactgggtaaaagatacatgggatctgtttgtacatttttttttttacaactgtgtgtgaatctatagttatctcaaataacaagtttagttttctttttttaaagattgtattcatttattcatgagagacacacagagagaggcagagacacagacagagggagaagcaggctccctgcagggagcccattataggactcaatcccggaaccggggatcaggagctgaccctaaggcagacactcggccactgagccacccaggcatcccaataagtttaatcttttaacaagcctacagcaaacattgtaattaatgaagaacatttagttgcatttcctttaacaataatgctcattgggatgcctgggtagctcagcagttgagcttctgcctttgactcagggtgtgatcccaagtccggggatcgagtcccatatcgggctccctgcgtggagcctgcttctccctcagccggggtctctgcctctctctctctctctctctgtctatcgtgaataaagaaataaaatcttaaaaaaaacaacaacacaataatgctcattgtcactgcttctatctggcatagccttagaggtcctggtcaatgctatgaaaaagaaaactaattaagagttttaaggatttgaagggatactctcagagtttgctgatgatgctattacctatctggagagagagggagaatatcaacagcaaacaaaccactgaaaccagcaagagaatccagcaagattgtctcatgtatgaccaacccacaaaaattggttaacttctaatgtttgcaaattctacatatgataaggcattaatatccagaataaataaagaacctctgtaactcaacagaagcaacaaataaaaccacatggaaaaacaatttaaaagtggacaaatgacatgaataggtatttctctaaagatgatatgcaaacggctgacaagtatatataaaaagatgttcaacatcactaatcgttagagagatgcaaatcaaaccccacaatgaaataccacttcacacccattagaatggctactatcaaaaaaaaaaaaaaaaaaaaaagcgggcacttgaacagatatttgcatacccatgttcatagcagcattattcacaatgaccaagaggtggaagcaacccaaatgtccatcgacaggtgaatacataaacaaaatgtgcaatatatatacaatggaatagtatttggccttaagaaggaaagaaaatcctgtcccatgctacaacatggatgaactttaaggacactatgctaaatgaaataagccagtcacaaaaagacaaatacggtatgattgcacttatatgaagtatctaacatagttaaattcatagaaacagaaagtgtggtgattaccagggctgaggaaagagggaaatggggagttgttgtttaatgggtactgaagttcagctttgcataatgagaaagttttggagatttggtgcacaacaatgtgaatgtacttaacactactgaaaggtacacgtgaaaatggttaagatggtaaattttgttatgtttttattttttttttttttttttgtttttttttttgttatgtttttaatacaactttgtaaatgttggttacacttccctacaccagaaatagctgctttgaaaataaaattacaaaatataaccaatcacaatgacagcaaagtccataaaatttcgaagaagtaactgagcatacaaggacacgatatgaaaaagtaaatttcaaaaagcataataaagagcaaacaagttgatctgaatacatggggagataccctctgtttttgcattggatgacttatatttttaaaaagccaattatccccaaattgctgaataaattcaggataacctcaatcacagttctagtttaattttgaggaacttgaaaaccttacagtaagatatatcagaaaaaataaagatccacagttacataaaccttggcttagggcaggggagactagaaatgagtattttctcaggtccccgagcagtaatattagtcttctgttattactgaggtcttgtccctgcatgaggcctgaggccgaagcccaggttttgcatctttctacccctaccaccacccaatgccacaactttggtttctttccttcaagtcaagtcaatgtgccaattgtcctacacctgtccttcttaagatccacatttctccaagccaaggtctgtcccaagcgctggcatgtaggatatcacagtttccagagctctgtggcttccctttgctttcagcctcgctctgagagcagagggaggcagagagcgaggccaggttttaactcctttagccccctctcaaggtcaccttagactggctgtgttccttgactgaagggcactgttgccagcaaggtagtgacactgaatcctgataacccctctaatctcttgcctttttggactttggggtagtgacaggtcagctgctacctccagtttatactgcactaccctctacctacttctttgtaaatacttctttgtaagtagactctccttgaactatcttattctgagtgtgccatttgttttctgttgacgctctgggataatgaaagtcatttctttcttcattccctgcctctgaccagcctggccaagggctcatttgcaatggaaaagtgcaagagaaaggttctggagagtaggtctagtctcccactggggagcaatccttttcggtttggggcctttctgctttctgtagcccttggggattggtgtggcaaaagtaattttcctaaataaacattgagatcagataccaatctttttctggccttttcacatgactatgtacatgaataaggagacaaagagaatctggaatgcaagtgcatgctgtcactcaggaaaaaagcactgaggatacaccctcccatggtgtacttgagctttattccattgcctttatttttttttttttaatttgagtatagttgactcacaatgttgcatttgtttcaggtgtataacatagtgattgaactcctctataagttatgctgtgctcaccgcaagtgtagctaccatctgtcaccacacaacgttattacaatatcattgactatattcctcatgctgtgtctttgattctcatgactcattcactccatgactggaagcctgtatctcccactccctttcacccatgttgcccagccccccagccccgcccctctagcacccatcagtctgttctcttgtatacataggtctgattcagctttttttttattcatgcgttgaggcttttttttagatcccacctatgattgaaatgatatcaaaagaagaacctcaagcttgaggtcaacacagttctctgaagtattgctatctgctccaagggttgaagggactccctgcattgtgcacgccctcatgaacacttttatgggtggagagtgggactagatgaccttaaaagtcaattccaactccaagttcagcttttaaaatgagctagacattgagagaaccatgtattataccacctggattagatataacccaatagcccaactacctctctcccccctctctccctctgtcccggtctctgtctctctcatatacacactcctctttttggtatttgattatgtttaacattctactctccccacacagccccagagctggcctaccattaccctacttctactttctatccaagcaccactcattctcccatgtaaggacatgtagttcctcccttttctccctaatctggcttcttggatcccaggagatctacccagcactttttcctactccttatctggaaggggacagctttccaaacaaaaacacaccaagttagggcagagggaagcctgccaggaacctccagaggaggactggaagctatccaattagctgactctctctttccttcccctggggtcctgtcactttgattcccactgctgtgaccagacccagaccctttggatatgcagcttcttcaaaattagccaggcatagataccacccaaagccctacacagaccagactagcatttcaaaaggaatttgctttgtcaaacaaacaaaaacaaaaaccatgaatggaaaaacgaaaatgaaaccacatacaactttaaacagcaagtttttaaatcaagtcaagcagagatggaagattatttacatgatacacaagctcatccattacatgctatatataaatgcaaaaaaagggaaatacaaatctgataaaattcctagagattaatttctgagcctacatttgccaattagcacagtgcacagcacttccctcttccaaccttatatggccttgctcagagaataatcattttggtgttttttttttttttttttttttttttttaatttttatttatttatgatagtcacacagagagagagagagagagaggcagagacacaggcagagggagaagcaggctccatgcaccgggagcccaacgtgggactcgatccccggtctccaggatcacaccctgggccaaaggcaggcgccaaaccgctgcgccacccagggatccccaagaataatcattttgaattcatgaggaccgtcccctcccattgatttctccagcaaactctttccagaacaaatgctctgatcacaaggttccttctgggggagaccatggatgtaaaggagatcaattcactggttgtacaaaccctgagcacctactttggacttaaagtctgtaagaacttcctatctgtaagtctataagtctgtaagtgcttcccccattcttctgtaggcccccatcagcacagaaacagtccaaggatgaatagtttctagcccccatgaccactccacacacacacacacacacacacacacacacacacacacatacactcatggataccagcacataagaaggttctgcagtcttctgtctcttcccccagctcaccagagtctgactttgaggattcctacatagctacccacatgcaaatgtacatcaataacccctcgttttccctccacaatattccattaggctaaggtgcttcagtacttgtctttacttctggtttctcttccttgcctgaagtctcctgtcccactgggattccaaaaacaatgccacgccccagctttctgtgtccagcaggtgtcgcccctcactagaaacaaaatgcacctctcttctacagtgcaaaatttgtaccccaacagtggatgtcccttggattaggggtaaaagggaatgaaagcatggctctgaagagtggcgtgctcactagaataaggccatctacttacttccagttaaggtagacaaacatcctatatagagaatttgttctttgatcttggacaagttatttacctctgaaccttgctttcttcatctgtgacatggaaggagacaatcttttcctcttggcattattggaagaagtaaatgagatacaaatacaaagccttagcccagcacctaggtcatgataagcacttgagctatgggctcttccccatttagggtatggaagaaataactgcccagaactcccatcccaagttaagctctgccctttgagtcctatctgaggatgtgtgtcaaggctgtgatgaggatcaacaaaataatacacataaggcacttggtccaatgcgtggcccagaaagttgagtaagaggtaataactaccatcactactgtgggctcagtgtgtgccagcaacactcttagccatctgtgagtatgaacacattcaatcctcctaagaccccttatggggcaagtaaactgttagctccctgcctctcccttatcctgtgactccatccaaccacagtttaatttcttcttatgagttacagatcagaagactacccctaattctgtcatgtctagagggaataactaggaggaggtactgactcctccagtcaagtaggagagaattaaccccaacccataactctgctcatgggccttccccagggcctcaggaaaaagcatagaaaaacaacattttcactggagtttattcctcagagatgatcaccagtgactcactggctcctgtggcacagtgtggcccccggaagggcctttaacctccctccccagatgatatttgacccagagatacagccttggacaataacttgattacagaatattcccagcagtgagttccccccaacttgctaaggtctacatgggatgggctgggaagttcaaagatctggatggagaaaccataggatccaagaaaatttgtagggtctgaggatgttggggggacatggcaacatcattaagagtttgaatctcctcactggggtagaagttgtaggattctgcctctaggagacatgttgacctgcaaaagaaatagaaaggagataatgaggcttcaaaccaacttgaccccatcatctgtctctataaccatccatgcaagccatacagtggtatcaaaaattctagatcaccaaggagccactttcaatcgtctccccatagatgctcaatcagatagaagaaaggggtgtaggtgctactattccctgcccctaataccaacaatggcaatttaaattatgctcttggctacatcctggtggaacctcactcctactataagcaccattagctgagcccaacacagactcctgagatctctcactcctccaaaggacctataggcaaatggaccaatagagatgttaccttctggataactggttccagggagaaaaacatagcctaggagaagaaaatgtttgattagaggacagtggataaaagtgcctggcatcactcacagcaaatgaggtagcaatgggagaaccactcaccaacagaaagtgagcagaaactaggagcaagattggcaacaggagattaggggtggcactcaccagaggagccagctctccgccagctgagcaaaccaagagagaagatgatgaagcccaggcccagagtcactccagacacagaaaccttcactgtctgcattggggacagcccaggtgctgcaaaaatagaaacttactataaccaatctgttgctcattgccagagaaacttaatttagtacaacctccacctagtaggtgcaaaggtgttctagcctaataccaagggtctagctcacaccaacctactcccaaggaaacagactttcctcaacatccccatcctgtagctctctactcctagagtagcactgggggacccctctcaccagagttggcaccctaccttccaggtcctctctaatacagtgggacctctcaaggcatcttttttcctttcttcaccctgaagttccctcaccaaagaataaaggactcctcattcccctttctatttaccccatagtgacaatttctgctcccttatgtgctctacctgagtatttgtctattaaaatgtctttccacctttcttaactctcaatgatcccattcatgagttacctgaatactgatgaatcttttcctgtccacatcgagatttccggaacctggctccatcccactccatagctcccacctcctgaaacccattgtattctgaatcccaccccacctggattcctttcccatgctaaaataaatattccatcaccaagggaaactctggtgcatgatgagaagactcccaggagagttcaggtgtgcttgtaggttcctctctctgctcttcatgcccttctcagctgcccagcaagacaacactccccaaagggggagcccagtctcaatagccaggctgggattctgttctctagccctccatagatatccctcttcatttcttccccttctctttccccatatatgtgtaccaaatctcttggtacgtttaattacttccagtcctggggttcaaacagtgctcattgattccttgttcattagcctccaagcatgtaaaccaaagtgtttgccagccatggtttttacttccctaatagagtagcccaaattcagtaccacccccacaccaagagaaagtcctgtttcttctgaaaccttttttattccagtaatgggatgtagccaattcccattactgatcagacaatacaatagttggaatctgaggatcctaaaatgttgtatcacaatttttggttttgaaaacaaggtcaccaaatcatatccccttttcaggacagccatgctgctccctgccaccctcgggcacacataaaacagcatcaaccacaccactatgccatcaatgacagtaactctttctattcctgtatcccatcgctgcatttctggttatcaaccctctaccagttcctccagacttgcttcccattctcagcctctccctccctgctatataccatggacctgtccatgtcactccctgtgccaaaatgttggtgttccttttttagccaccctctcgcagctctctgcttcaaccctaattcctcccacccaccatacacttactccagtcctcacaaacaggctcaggggccccgatgtgctccacaacacaggtgtaggtatcctcataagaaggggttgtagctagatgggagacagtctgatatgtccagtctccattgggctgggccatattaagggcactactgtgagaagggacaggctgcccattcttcctccatgagatggtcacatcagctggatagaagccccacacgtagcaggccagcatcacactctccttcgtgttaaaaggagtggatttggctacttgtacagttggtggtcctgcatagggggaaaacatagtcaggaaagaggacaacattctggctttttctccaacctggtttctttcctacttcaatttttcctggcttctgccaacctaccctccccacccccactccatgcctccacatccctttggaaaagaggagttaggatttactcctgctttgctctttctttcctcccattctttcactgccctttcctttctttcctgctccaaaattacagttgatcacattaagtagaagccagttctgaattgcaggctgttccagaagtcgctgtatttatctcaagtatataagctaacagttgtcaagagttgtaggttgaggtttgtaaaggtagggaaagacatctgctctcaaatctaatttaacaaactaagtggcttcaaatgaagcagcattttttacttcagatagtttaaggaaacgagcctaactcagatctaatgctcttaaatttggaattgtgtaatgcaaatttatggaattgttaatattgccattctctactactttattcgcctagatgaccctcttgcttgcctctatcttggtgctgttcaaaacagaatcttatataaaaatccaagaaattgtgttaaaatgcagattccctaggttgcttcccaaaatattttcaccaagtggatctgtagtgacattcaagggcttgcattattttcttttaagaatgaaatttttagaagattttatttatttatttgagagtgagggaccgaaatagcaagagagagcacaagcagggaggagagggagaagcaggcttcccactgagaagggaacccaacatggggctcgatcccaggacccgtatcatgacctaaggcagacactaaccaactgggccaccaaggcaccccaaggtcttgtatttttaacaaacatcttccctaggcaattctgagaaaagtggcccagaaatcacaccttaagacacattactctgtcttgtggaggtcttcatttttcttttaccaatctcaagtcattctcagtggaagggctttggggcaagaaagcatgttgaaatcccctggaaagctttctaaatattcctatgcctgggcccatcccagacctagaatatcagaacctatgataaagaggcatgagcatttggagaaaaggcattctggctattcttacacattcctggttgaacttaattctgcatcctgagataccctgaatagaaggaaagcatgcttactctctcaatagctccctagtggcctctttattcacccatccccatcaacaaccttttgagggtcaacactcactctttctatattccgggtccatacattttctgcttgtttcctccccaaatctcaaatctcttacttatggagggatggagcgatcctccctggcctccctcccctttccaactgtgcttcccaatagcccctttgcacccctctctccttacgtgttctgtgggtcagtgatccccagaaggactgggtatgtgtggcacagtcctggagcccattagacaagcgctggtgcaggtattcctgttggttgaggtaatctgagaggtaattggccaagacattcagtgtcccaaattcataagggaccattttggcctcatctggatcccagcaggtcagcaaatccttattgaaggagacacaatatgtgaaatcctttggagtcccatcatcatccaacagacaggagctttccacgtgagctataaagccacctacagaaaccacagaaggacggcagctcaaagacctctgcaggaagcccaagcctcagttacacctaatgagtggggtgtagttttcctgcctcaggtagcatctagagaccacactcatgtactggagtctctgagagcacaaattaagggaataggtggtagtagcagagaagttttcagatgctatttcctctttatgagactaagtatgggaacaagaatagaccaaaattattagctagttcaagcacagcttacccaggacaaggccatcagtagagcaaattattgaatgagaaaggggtcaagagaaagagtcagctttgttgtatgctgtatatattaaatattcactccaatatatatttatgaagcacacacacatattatgtgctaggagctgaggatgcatcagtaaacaagacagatattgcccttgcccccactccaggaaatgatatgtattacacaaataattatacaagcttaattatattaagatcactacaaagatagaaaggtacaaagtgctatcagagtacatactagagagacaaactagtctgggatgtctgaatccaactgacccccctgtcccaaaggagcagaggaagggaaggtcccaggcaggaaacccttaccttctccggtagagcccagactgaggcccagcagcaatggtaggagtgtggtcatgctttgctctaggaacactccaggaattcagtcccctggaccagttcttccagggtccttgggtcctcgcctgctccagtagcccagcctgggtagatgttctccagaccctgagtggaataccgtattgccccggctccttgatccccactaaatgaatgatttggagccacccatcccctagatactaaacccgttccaaccacctcttctaagtcagtcccaaactaagagttgtcagattggttagagaggcgaggacaaatacagagacaaatcgctgagtgctttagcctagcatcatcagttaccaggtaaatcttatcctgccttaggctttaaacaactccttctcttaactctttccctgtgagaaagaccagtctgtaggtggatttccttaatcagtgaaaagaataatcccaatattcccagaacatttgtaacctgggcagcccaatggtttaactgtttcctttcaatatccttccaaaagactgggactagataacttctcttgtcccttagagtactcagattttgagcaacccttggtctgtcctgttacctggagatggaggtgggatggtgaaaggcccttccggagctgtggcagagccaggaatactaagatggaaggaggtattaggagagtacagagttatcttgcctcaaaacacaactgcagaataagggaagcagctccactttagaggttggagacagactggaaaatccctccctgggattccattgctttttttgttctagccagcagaacttcgtttcatcctttctgctttttggagccaggaaatcctatcctccaccactctgagctatcttagggcagaccacaggacaactccacttaaacccttgataaatagctggtaatggatcagttcccgaagctcaactgcctccccaaactcaacattcaacagtgtgtctctcccactgagcctatctgtcccagagcaggtccctgcatatgaagccactagaaaaataagacctggaaaggcagattttaactggcaattcattctcctattccactgcgaagtatatagctggtggctttttctatcacaaacttaaaaccctaaattggcttctctctattccccagtggcttcagagctgtgtctcctcaccttagtttctgcaagcttttggatttgatttagtagtgagctaaatgaaagaggattaggagacccttgataccacacttacctgttctcctccccaaagtccctaatctcaagagagtcaatatttatgaagaaaaagaagcatgtaccaaaaatgaatagaaagatgaaaataagaaacaaaagacttgtgtaactaatcaagattaactgaagtcgtgtccatgtttcccagcacccccactctcaaccctaccttcattataagatgtttctatactctacttcctcaataagccatcaggtgagctagaatgggcagaaaattgggtggtgggtccaaaatgtgttgagcttcaactttggaactgatactatactaggtaggcccttcccatgtcatctcatataatcttaaaagacctaagtgtcttcattcttacagttttgaaaacaggtccaaagattcacacacaggtgcacacacgcaagcatgcccacacactcactacatcttgaggctgaggtgacccatgtaaaggtggccagcgctgacctccactgagagaaagataaagggaaagccacttgatctgttcaagtcttagcttccctgttctcagaattccttctgttcttagaacaagtgtctcctggctttctcttttaacagtttcaaaactgtgcaaactcttccccccaaccatctgcatacacacacttcccctttacattcttcctcctccccctaggtaggcggtgagcctaaccttgcaggaaccagggcttgggatccttttcaatgtctacaaagattgcactggcacaggaatgcatgcggtgaggtcccgtgcctgcacagggttggccacctgccagggagctgaggccacgcagagttccctcttgagtctgagtgtctgccccggcagccaaaggagatgtgaaactatttgtgaggcagcagcaggaaatgcagaagatttcacttctctattaataagaagactgagagtactttttagaataaagcaagacagaaaacccagagacctgtgctcagtgatttcttcattctcctcttcctcctaattttacggacataggtaacccatcaacccaaaagaacattttaggtgccctgtccattgtgattgaataactatttctgtagtgccaggaccaccaggaccataggaatgagggagctgtagccgcgttcccacatgctgtccctcttttactggcactacccaagctccaagagccagtcctctcctttcacacacctctccccctgggctgttcaccacgtgccacaagtggactaactatggtgttcctgtgcagagcattacaagaaatacccagctaggagatatggactctgcccccacgccatttgcttttaggtcaattggtgaataagaaaaaacatttgtaaagagaagagttgatgttaaagcaagtaagcaataaggccagtgtacttcaaagagaaaagagaaaccattgagggcatggtggacagaaagtcctctccactgaggggtgctggaggtgagaaccaaatactgggctgaagccacgtccagaagagaaaggcagttggcatcgcagtcctgacatataactccacaagcttggcaatgttatgaggtgctgctgggggtctaccagaagcttggattgactaaaacaaaaaggaactacaataacatcatgggcatcacacactgaaggaagtcacaaatgtggtctcatgctcttcctgagagcatggacctaattataaatcccttctaggtacttccttatgttgctccctgtaaattctcaggttcctcttctggacagatggttttaactcaagcctcaatttcataaactcaaaaattgttcaactcatcaatcatttgtgatctgcaacctgtagtgtgagaccacatttgtgacttccttcagtgtcttctcaaagaacagtgtcttctcaaagacctgcaccctgccaggatttcattatctcccagtctgtccaacctcatccctacccacccccacctcacctctgtcctcccactctctcttctctatgggattcactgctccagaccctgaccttggggttacagttgctctaactagcccattatccttccctcctgcagccgaatgacttgaacggctagggaatattctacctcctttgctaccgcaactcttgaataatatcattatctccatcttaactatgataaaatggaggcagagggaggtcagcaaccatccagatttatccagacatgaatagaaccatgatttgaactgaggatttaggattctaaaatctatactcctaataatcagttagaaaacaactgaacattgctagccatttataatagtaacaaaaaccataatgtgtttagaaattaacattaaaaagtataagaactttatgaatagaagggaaaactaggggatccctgggtggctcagcggtttggtgcctgcctttggcccggggcgcgatcctggagtcccgggatcgagtcccgcattgggctcctggcatggagcctgtttctccctgtctgtgtctctgcctctctctctctgtgtgtgtgtgtctatcatgaataaataaataaacaaatctttaaaaaaaacaaaagaagggaaaactttattaaagtacataaatgaacacctcagaaagtgaaaacatattcatggatggggcatcctaacataacaaggaagttaatttcttcccatatcactaacctaaatgctgtcctaaccaaatcatagcaagatttggggagaacttggcaaagtgattctaaaacatacatggaaatcaaatccatgaatatcttagacaattctgaaaagaagagcaaaataggatttagggagaggtgaagtgatagagaaatgaaaccagccctgccaaatattaaaacacgtgaaaagccgtaataattaagacaatatgacactgacataggaactgacaaaacaatggactgaataattcagagacaaatccatacatatacggaaatttggtataaaatccctgggaataaaaaataaaataaaataaaataaaatccctgggaataaatggaatatttagtaagtgatattaagaagatcaatttactatctgggaggaaaagaaagttgtgtccttattcccaacatatagaaaaactccagagcaaaaaatatctgaatgtgaaaggaaaacaataacatgaatggaagaaagcatcgtgaaatatcatatatggccaaataaatataaggcaaaggttttccacccaaaactactcatcagaaaaaaagacaattacctcatacataagtcctcaggtttttttccttttcagactaggaccactctttcaaagctgtttggagaagacacattatcctaaaatgatgtcaataaatataagaaggggactccacactgttttctatagtggctgcaccaatttacagtcctacctacagaccacacaccggtcaacaacaatatggagattcctcaaaaaattaaaaatagaactgccacattatccagcaattccacttctgggtatttattcaaagaaaatgaaaacactcactcaaaaggagatatgcacccctatgttcattaggcattatttacaacagccaaggcatggaaatgacttaagtgtccattagtggctagatggacaacatatccatatggctggacacacataaatacacaatgaaatgtgattcagcctaaaaaaaaaaaaaaaaaaaaggaaacctttccatttgtgacaacatgaatggaacccaagggcattatgcaaagtaaaataagccaggcagagaaagaccaataacataatttctcttatatatggaatctaaaaaaaatgaaaaattaaaatagaaagagttcgggacagcccgggtggcccagcagtttagcgctgccttcaacccggggtgtgatcctggagacccgggatagagtcccacatcaggctccttgcatggagcctgcttctccctcttcctgtgtctccgctgctctctcgctctctctctctctctgtctctcgtgaataaataaataaaatctttaaaaaagaaaaaaagagttcatagatgaacaggttgatagttgtggggggcagggaagataaataatgaaatatttttggtatttattttatttaaagaaagtatttttaaaaataaataaagaatttggaagtcattcacataatcaaaaaatacacaagaagaataaaaataaattcatttggggtgcctgtacagtgctgtaggttgagggatcgactcagttttggctcaagttgtgatctcaggatgttgagatcaagccccacatggggctccatactcagcaagcatggggtctacttaagacactctttgcaaattaattaattaattaattaattaattttaaaaaatttttaaaagacactctttccctctgtccctcccccttgaacacatgcacatgctctctctctcaaatcttttaaaaaatgaaaataaatttgttttatgacattcaagtggaaacagcaccatttttatattaatacattgagcaataaaatatgtgattttaatctcatgagttagtaactaaataaagatagctagcagacgttttactaacttctacatccctcaaattttatatattgaattggtcaaaaaacttctaaaatattctcattgagaaaactaagtattggggctcctgggtggctcaggggttgagcatctgcgttttgttcaggtcctgatccccaggccttgggattgaatcctgcaatgggctccccgcagggagtctgcttctccctctgcctacatctctgcgtctgtgtgtgtgtgtctctcatgaataaataaattctttaaaaaaaataaataaaactgagtatcattttatcactttatattccagcaaaaattgtaactttactgccttggggttgggaaggatttcttaagattataaaagcacaaatcatgaaggttctgaccgttcgtcaaaattaaataattctattcaggaaagaaacatatacaaatttaactgataagcagcaaactggaagaaggcatttgcgatatttatactgacataaaattgttacaaagactatataagaaattcccacgaattcacaagaaaatgcaattttttaaatagacaaaagatatgactcagcaattcacagagagagaaaaccatgaaaagatccccgaccacagtagtaacacagtagtaacacgaggaaggcaaattaaaatacacccaccatactgccatattgccaacatttgaaagttaaataatttcaagtgttagtgaataaatgaaaatgagacccaccttccctgttgatggaaggataaattgtttataatccctgaattacttaaattacaaactagttaggtgaaaaaaattaacatatgaaacaaggcagtatatccttgaaagcagtctggatcaaagtgcattaagtcttagtaaagctcaataaagattatttaaggctgcagggagggcacttggctggctcagtcataagagcatgcaatgcttgatcttggggctgtgagtttgagccccacatcaggtgcagaaattacttaaatttacttaaataaataagcttttttttaaaaaagtctgcaggatgagggataagttcatggaagaagttgaatttaggtgggatctatagcattggttaagctgggaacaaggggagcagaataaagaaggaattacagtgagaggaagcctgtgtgccctaaagagaacacagacacagtacagtcaaagaagagtggtgaaaccagattcattcaagagtaaggatacctgttgggaagggggacaccagactagagagggtctttagtgcttcttgagtatttcaagtgacagtatcatagaatgtttgaccagagagcatctaatgtgaagcccatcattttacatatgtgggaattgaggtccacaaagggggtgtaacttgtctaaggtcacacagtgtaataaacgcagtctgaagacatgactggcaagaaatttctagataagttggagaatagataaaaatcaggaagaactacaaaggagtaagacacatgtagaatggtaaagagaaaagaaaaataaaaatatctcaaagggagaaaatataatacttgaatgtagattcgaagtaggttccagaaaaaaaagaaagaagtcagtcatgctgctaagtttccctatggaaatccttgctcaattattgatcagcttttccatgtgccaaacactgttctaaagcattctacgatattgccttatttaggtttcacaacaacacctttattatcatccttttacagaaaataatgccaaggcacagagaggttaagtaacttgcccaaggtcacacagctgaaatttgacagtcaaaattgaatccttggcagcctggttcctgagcatactattaagcagtaagcatgctgctattagaaatgagatgggggaggggcacctgggtggctcagtggttgagcatctgcctttggctctggtcatgattcccaggtcctgggattgagtcccgcatcagtatccctgcagggagcctgcttctccctctgcctatgtctctgcctctctctttatgtctctcatgaataactaaaaaaaatctaaaaaaaaaaaaaaaatgaaatgagatgggatagaggaggtgccaactcctaggaattggatctttcccttagattctggtacaatgtgaaaaacagagactctctgaccaataccaaaataatttcactcttaactttaatgccaccccctcctccaaagtaacccccagaccctaaagaaagcaagaaaaaaagagcatgcaaagtaatttaccaccagtagtcacgtgtcccctgcccccactatctgctcagggcagcaccaccatagttctccttggatgatccactctggccaaagaacaaattgtttggagggacacatgaattgtcccttcaggctgtttcaggagcttgaatatacggttttcacagaaacaacatgattcagttagaacagcatttgaaagcttatttttcccattcctgacctcccattttcccagctacagtgaaggttgaaaggagttatatatttcccaaggcagcttatactagccataaacatcttcacaaacagtaaaatgaaaaaaaatatccgcaatcagcttcctccacggttttgtgagcagattatcagaaaatagctctgccttcatttttcatgtattttgcacaaacggagaggagtaaaagccattgtatggtgctgagaccagggaacaggagtcaactgagaagctaggggttttcccatttccctccctaatgagggcaagctgcattcaagttaaagcaagttgaacttgaaatgacaacccatgcaatattaagaaataagatttattgccctgaagtgggaaggaatgtggttgtgataagtaagctgttctgggtacccctgggtgcaagtccagggacagtagagccccagctgagaaacttgtacacatcctcacgcatacactcccagaggcgtcctggggacttctgctctgagaaagggagatcctgggcaggatgccagaaacgtgagttcccactgcatgcatggttgaccctgctggcaccagattctggtcaggaactatcgatctgaggagagagaaggatggaggaaagccatcaggaggaccccccctcctccacaaaggcctctccctgcctggtgcatatcccatacaagttgatctctctttggccccaagttatctccaagcacccctcctatagttccccatatcactcctctcccactcaaagccatgcctgtgatcctataactgtgtgtatgtatgtatgtacgtaactgggattccaaccaggaggatgtccatggtgccgacacaggcctccctataccacaggatgaccttgggcatgcccccacatgcaccactgtatgtggctcccatggtttgcccacccactccagacaccccgatgtaccatgagcaaggctttcggaagtacacgatgaggactaagccaacaatgatgcccagcatacccaggccaaaggctacaccacacagcacattctccagaagatcagagggcagcgcatcatggggcactggagaaaaagaggagcaagtcatcctggagccttggtcggtgagtccccacccaggggaatgacttggggggcagggattaaacagaagaaacagaggcatgaaaaattgaagttgctcagggtgagaatggacttaagcaaagtgcaagtagagaaagaaagccctcccatgggtccatccttttttgtccccaaaagaaagcaggcttccaaggagaaatttctcaccccaataggcaattgccgtgtagttgtcaatctcatgagtcaccacgcaggagaaaagatcagagggtgccggtgtaaagtttaagtaagaaaaggcctggaagctgaatccatcaacagcggacacaaaagtgggcccgattccttccacagggtccaagtgatgccaccagttcaccgtcaatgtgggtgggaagagattactgataaaacagaccagcatgttgggtttgccaaactccaggggcttcaacgtgaacacgtcgaccataggaaaccctggtgggaggattgaggtgtgagggaaagaagtaactagtttacatggtacccctgagtttggaagggatgtggtatacagaggggagtgtagagacagtgtcagtgggaatgggctttggaaggagagatgagggaggagcttgggctctgacggaggtcttcttccaggcaagtaccagaccttgactagaggcagagctagatccaggctactctgggaccctccatcgtgacttcctgcagcacttcctgtctacagttcacaccatcatctaatcacatgctatcttctcactgaagcacaggcacatcattagatacttcctttctccccttccatcctcctgagcatagcaacacaagctctaatattccgtaggcatcaactagtccctattgcattcattaaattcaataaacagttctgaacacctactatgtcctgagcacaagtctttgtcccacaacaaaaacagagggcagaccatagctggtaaggggagacccagacgacattagaggaggggactggtgtgaaagggaataattcagtgtacaggttgaggaggttaagaatgtagcccctctctctgccccccgaaacacccctgacctctagacacagggatttgcccttcaagttttggtcctatttcctcaatcatagcttggcagaatgctttgtcaaaggaaatggtgggcatatctccagacttctgagcccagtcagcaaattcaggcaggcgaggcactcgagtgttctgggaaaagttgaaggagaaaagctgatccccatcataggcttccaagagtccgatgctgggactccagttctggcagtacatcgtgtgcaagaatgtgtggttttgcagttcatcccgccatgctagagtaggagctgcaaaggaaacaaggtaagtcaggaaggtgggagtgtcctcctcctccttagcttagaagacagcaaggcctgcttcaggcagaggggtaggattggggtgtgaccccttcttgtgtctgttatttaggctctccctcccaataagggtgaagaagaaatcacaggatctctccaaacttcccctgcccataaaaaggccaactgtctaaagttgtaaaattaaaaaaaaaaaaaaaaaaaggtctaaagcaacaaatttggagtcacaaggttgggttgcctgtttgcgtgttacatgaggaatctggccaaggaagtaattgaaagttgaaatctagcttgcactccgctcaccaagcaagccacatggcacagggctgcatcctcccaaaaaagatacttttgtctaaatcacagaaggccactatgttaacttgtgaagggcttcgatgggttcccccaccttagaagggagggtaaattaaggaatggtcatggcctccccaagccacacatgacactgccccatcttacccccagaaaacatggttagctaaaaaaccaatctccaggtttctcttcagctgcttcatcagcaccagacctctctgaaaacctcctcatctccctcagccctccagcccctgcaatgtcaggagtgggaggacccaaagttgtaggcaataatatctatcctttggaattcctggcaagaatctccccacacacaggagcaggaaactttctatccagtactcaatatctagaataatagatatttagaggaagaaggatcttcagattattcatccattccacccgtcctttacaaggaaggaaactaaggaccaataaaagttaagagactttcaagaaccacaaggtgagttgatgacagagtgcagagcagatacctaaataggacagtaacataatatttactttgttcaaatcccagctctgccactttccaactgcatgaatttgaatacattaccgaaagtctcttagtctcattttttttttccatttgtaaaatggatataataatctctttcaagagattgtttcgagtgcaatatataaagcacctctgacattgtttggccatccatccatagttgatctctttcccaattctgctattgtttccactactccataatacttcctgccacttacaaagcacagggcttcaaatgcaaagaagacttcaaatgctctgggcagttcgctaggctctgacctgtcaggattgaagtaaaggcgaggtattgtcataccttcaggggcggtccgggagtagggcagcagccacaggaggtgtaacagccttagcagtgcagctccctgcctctgctcatgatccatatcttcacaccacaccatgggctaagacctaccaaccagctgacccagggccccaaattccttccccagatcatgttccaccagctagttccaatagttgcctttatcacttggttaaaccaatcacagaagtgtagggtttaacatcatcagttgctggggagagacacagtgccagcaacctcttctaagacttggctctttcaccaggccagagtcgggtgtgtaactgggctgggaagacaatggagggatgtctgcctcctgctggggatccctctgtagtaccaaaccgtcagcttaagctggtaacctaggcaatgggctcttcagagcagcaccacctcctggcagttggctgcagtggggaagctcctcttcccacggcaaactcccagggctcttcagaccccgcctcctcctccctccagccctccttcctctttttctctctgagaggtgttcttcgggcattagctcaatttcattctgcagaaatacatggaaaatttaataagtactagtattgggtccagtgctagaaatacaaagatgaataaagggtattcctgctttcaaagagcttaaagtctagttggcggggtgggggagtcaatgaataaataattacacaacaatgtaatgtttccaacaagaatgtgctcagtgttttaaaagtattaactttatgaggatggaacataatccaagcttctgagaatcttgaaagaaaaacaatttgaccagcagaacctgaaggaagagaaaagcattctagggcaagggccaggcgaatatgtgaaggcaaaggcattcagagctccttcccttggagacatctgtgtggttggatgtgaatggtgtggagactactgattgtgtccctgtttggtagtagtgcatggaggagtgtcaagatgagctggaaatttaagcaagagccagatcacataggccatgttataacacaaagagggtctggcttttagaggtattaaaactgaggagtgacccaattattttaaattttagaaaaactggtcttcaaaaatttcaaaggatggactggagcttagaaaaaattgagctaaaactgctggtcagagtctatattacattacatcaaaataagttgcacacacccacataccactctttttttagcaatatagcaataatttagttgagaattgataagaacctgaattaagtcatgaacagaggcaatggagggaatagaatattgagataattaggagacagaatctaaagggcttggctactgattagccaagcagaggagtcaaggccaacactaagatttctagattagctggctgggtgggtagtcagtaatgaaatagaaaaggagccaaagaagcagatttgatgaagaagaggatgagtttagtgttgtacatgtagaatgtgagatgccagtgaaagaaccatgcaggagacatgaggtatatgggtatagaactgaagcatgggctgagaaacctcaatttgggagtcatgagcacaaatgttgaagcagaagcagtggataagatcatgcaagtagactgtgcagacagaacaggaagtggcatgatgtaagtctgcatggattccaaccccaaccctcttaccagttatcatccaggatctagttgggaatatagaaccactctaggtcttccagactcagggaatttaatacaggaaatcagtcacaaaggtgttaaaagggcaagaagtacaaaaaggaaaaggtgtctggaggcacaaatagaggaatatctagaaatcagaagctattcttcccctgacatggaatccacgtccatgcctgctgttgccctgggactgacaccatcatagctagttctggatctgctgaaaaggttccatcttcttcaaggctggataattgagaagatgctttctctacctagaaggcttacgtccggaatcacccattcttactgctgccatatctaccagcaactgtcactctgttagaaactaaagcaggaagcttctcagtttcccctgccttcatatcccttgccagtgcctcctattgggagaatataatgggaagccaaccagctaataagcctaagaagtacatgctttacagacgccttggccaagcagttcagaacacagtataggagggcaagcctggcactaacaccagaaaataaccagtacatggacatggaccaatttgtagagatttggtgacaccaggagcatccagatagccatgagagctaagagaagaacaaggaaggagcagattcagagaagcagaggtgttccatgaagaaggacaaggtcagcattataaaatgctacccagaagtcaaggaaggactagaagtgtccttagatttggcaattatgaaatggttgacaaatgtattgagagcagtttcagtgttgtagtgggagttgactccagattgtggtgggctaagaagcaagtgggaggtgagggagaaaactgtcacagtatatgctgggaagtctaatagagaagaaaaagagagaaagacagaagggatgggggaagaagcagtgagaaacatctaatgtggcaattaagtaaccttagaaatcaatctatgtgaatataatccctcagtatctcagactttcaaaatccatactcccctttgaaaaataaatatcagcagcaataatagccaaaacccaaaacaaccccatgatctcctggatattctgaaacactaatgtgtatatatgtgcaagcacatatatgagtttgtgtggtggggggcaggcagagtggcaaggctggagtagggtttggaaatcattgtgttacgctccgaaaaacagaacattttcccaatgtcccactctttgtagacttatccatcaacagttcctgcagtgggaagattcaggccttttagggcagcagaaaggaagtttatgacatcatcaggaccatagggggagacatagtgcacacagccacctagaatctaaggcaggagaatccgaaaacctctgtgaaggatcagataggaaatattctaggctttgtgagccattcatctctgtgttatgcactcagctgcaagtgcacaaacagccacagacaacatgtcaatgttgaaagagcatggctatgctggattcctcccagcttcctcccacacttcctgggcatctcctcagtctccttcgtggaccactttctttcagtcattctgaaaacaccatttaggtggtgttccctggagttttgttcttaaccttttttttacttatggacactggaatttaaatttcatacaattttcatgacatcattctttcgcttttcttccaaccatttaaaaatgtaaccatttctcttagttcttgggccacttaaaagatggtgggctggattttgctccatactatagttttctgaacaccattctctgtatgtggtcagaattgagatggggactcaaaataaaccaaagaagggctccatttccccttgggggtggctattgattaatgattgtggcccagataggacagactgtttggaaggaggtctgaggggacatgaggaagaagactaggtaggaaggctaggaacaggtaaagcagtcactgcaactactctgcgtgagaggaaagaaataaaagggtacaagttcttcacagattagagtgtagacaagatcaaggtgagcagatatataaccacccatcatcaagactctggccaggtgtggtcaactcttctctcccagtaaagagtaacaagttcaaacagttaggactatccttccctctatgcaatcctgtcagtactcttcaacaagttctgtaacagatatctcaaagagtctctaattagtttgcagaagtaattgcatgcgagaggagcaaggcaattggttctgtatcccagtaactcactgtatattttggtcattaaataggaatgtccctgaaaataatggcacctgtgaatctagtagctcatggctttctaacacagctcactcatccctttctagccccatttatttttcctagaaggccaaatttcctgaaaagggcatgggtttccatatttccatttttatacttgccatttatgctgtaactctcaacaatgagactgttcatcaatatttttgagttgttaaatcaaatgaactctttgcaacatttgacactgttggccatgccctccttcctaaaatggcctattttttggcatcatgaatctctcctagtctttttgctcctacttctttggcgtcctcttctctgtcttctttgtggactcctttcttaacagctggtgttccctggagttttgtcctcaaccttttctcttctcacatttgtcctggatggcatgccttcagatgcctcctatttgctgatgtcttccaaatttactccttgagctcagttctttccctgaatttcataccacccatatactcaactgcctttcaacatctccacttgacctccacagcagttctcaaactgtattctccacaaaagtgtccctcaagaaattttttggactgtaaacttgatagtagcaattttttaaaagattttatttatttattcatgagagacacacagagagaggcagagacataggtagagggagaagcaggctccccctccccctgtccccctgggacagatcccccagtccgggactctgggatcacgccctgagctgaagacatgctcaaccactcagccacccaggcgtctcgatagtaacaattttttatttttaaatttacctcaacacagaggtaataagatgccaaacacataataatctcattatgtaatcatttattatattgaataaaactcttcgagatgtaggcaatagacaccaattctggctaacttaacttttaaaatggcaatttactggaaggatactgagctaaattcataaatcaaagagaaatggatagtctagcctcagaaaggaaagcctcaggggtctagcagcaaagagctgagctgctgttaattacgcctcacccttaaagacctccagccaccatctcccaagtttcacattgctgggagagatgatctgattggctcagcttgtattagtgtgtatctctggatcaattagctgtggccaggcacaatatcacccctatgtatcacagttattcccagagaagggagaatcatcatgaaccaaaaaccacctcaatacgctatcttcaacagatgacatgctggacaattgcatgacatcatctgagacattaacacaaggttaaatctgtgtattaatgctcagatagcattttccaactaactgcctgagtgatatatgtcttccacttgatctctggtctgtcacaagtcttggcacaaattcgaaacatactcataatatgattcagtgttgacttagtaataataaaaattttacattccactaattgatttcttttagatctatgactaaaatatatatatttttaattttatggtgaaaaatttcaaacaggggcgcctaagtgctcagttggttaagcatctgactcttcttttcagcttaggtcacgatctcagggtcataggttggaaccctgtgtcaggctctgcactcagcagagtctgcttgtccctctctctttgctcctccctctgctgtcctcccacctctatctctaaataagtgaaaactttttttaaaaatttcaaacaaacataaaagagaatataataaatcctcattttactctcatgagcttcaaccttctaaaactcttccattcttgtttcatctattctgttccatgtcctttttatctattctgttccatgtccttttttttttttttttttttcttttcttttctgggctattttaaacaaattctgccattatatttctcagataacttttcttttaacagaatacaatactattaccacaaccaaccaaattaaaaacaattgtttaatttcatttaaaccagtctgtgctcatttttccccagtgatcttcaaaaatgtctaaattctaaatgaaaagcagtgtgttatgatttccaaactgcattcatttcaaaagtattgacaagttttttctttcttttttttttttaagattttatttatttgagagagagagaaagagagggagggagagagagagaatgagcaagcagaggggagaggcagaagagagggaagaggagactccccgctgagcaaggagcctaatgtgggggggggacttgatcccaggatctggagatcatgacctgagccacagcagatgtttaaccatctgagccatctaggtcatttacattaggtctcaaaaacctctgttgatggttcaataaagaattctaataggcaaatgaagtctagcaattacaatcttgaatacccttccatctcaaaatttacaaaactaagctcattaccctccttcccaacaagttccaactcctatattcaagacctcagtaaataacttgactatccaatcaatcatctaagccacaaatctatgagtcaaccttgaccacttcatcttcctcaaatcttctcatccaatgtttagcaagtcctatcaattctaccttgttaatatctcttgcatctgtcctcttttcttcccattcccactggctcaggccttcattgatttgtttgcttttccctggattactttaactttcttcttcttgatctgtctccattcttattttctagtgctgccaaaggaatctttttattatgcatatttcatcacatcatactttggtacaaaaaccttcaatgattgtaatctgcttccttagtatgatccttaatgacctgaactccatttaacctatgtctgtatgtcctttgagatgaaatctcacttccctcaggaagccttggaacctggaacagggattagtggcttcttctgtatgctgccacagctccctgtgcctgccattaccatcatttttcttgtactactctctctatatatgtgcttcacagtcatctcaccctcactgcaagatccttaaggaaccatgtcctattctttttttttcacactcttagcatccaccaagaagatacaccaacaagtaactgttcactggatgaatgtgtggtgttactgaagatgatgaaaccgagactaaagagccctcaagcattagatgaatgatagacaatcccttcaaacagtcaacagtaggtcttaccagtcatgcctataggctaccctgcaaatactttcacctccactgccttccctgtgcaacccaccattctccacactcttcccattccattctaggtccttcccaagctacatgccaactgccattttcttcctactcccttccacctcctgtttcagagagtgaacctagtcatccatctcccatttaccctcattcccagctcaatatctcttcacatccacgaatgaatgttcattctttcttttagctactttattaggatgtagcaactctgtcaactacaaggttggaatttattattccatatataaataagaaaaccatggctcaaagaggtttgtttgtttatttatttatttagcaagtatgtattgaccaccttctatctgcctggcaggatgctggacaccagacacctaccatcatcacacttataatctagtgaaaatagagatattaaacaaatctaaaaatgcaaattataaaaggaagggaaaaaaactgagatctgttagactaactggaatggggaacctaatgatacggagatgagatctgaagggtgagtaggagttaggcagagtgggaagaatgctcctcttggagggaacagcagtagcgtaagccatgaagacaggcaagagactagctagctccttcaaggaagtgaaagatcagtgcggctggagcataatcagcaagtagaagatggtagatgaggccagagtcgggcagaagcaagaccacgtgggaccttgtggaccacagggaggcttgagcccccttctaagcatagatagtcctgagattgcaactactttattccttctcatctcacatgtgaatgcatgctagctgacctacctccagtctctccgaacccaatccatggtgcatcctgttgccaaatagatctccctataaaggtagctttcacttctcctcttagaaaagttaaatagttcccttctttctactatattcagtctggattacttggcctgggttttcaggttgcccatgctctgtattctttttttttttttttttttttttttatgatagtcacagagagagaaagagagggcagagacacaggcagagagagaagcaggctccatgcaccgggagcctgatgtgggaatcgatcccgggtctccaggatcgcgccctgggccaaaggcaggcgccaaaccgctgcgccacccagggatccccatgctctgtattctatccccagcttacagaaactgctctcaatatcagtaatgacccccaattaccaacccatgagttttccttctttgtctgcagaatatcactttctcattcaatcagaacaaggttcttaacttgcagttccacaagccacaaaattcaggggtcatgaacgtggatggaattttttaaagtcacttttatttccaataacatcaaactgaaatttaagtttaggaatgtagaaagcaaatctttgtagtactagcagtacctgcaatgttttcatcaatagaaatcaattaatattttcatgtcacatacagatatctcaaaatatctctataatttaataagttgttagacttgccaataaatcattttatttgttacttaagaaccacatgtattatattaacatggaagcacatattactggatcatcacacacttctttaaacataattctgataattatgtgttttatttatacgtttacaaatggtattgtcaaacaaggtcctaaggctctagcagactgtcaaagaagtccatggcacaaacaagcacaactcctgattagtcatttattcaacaaacatgaagcccttactgaggccttgtcttgttctggcatcttcatattatgtaattttgcttttctttcttgtttaatactcttccattggttctacttcctattctgttccctgaataaggatctaacccaaagttcaatcttcgactcaaaactaaattctattttatacttccttataaatctcatctacctgcatgactgaatcaaacatcaattcaaagatgactcccaaatctacctcccctgatcttttttctcaactttagtcctagatcttaaactacctgctgtgtttagcaaccagaaaaacagatcatccatgggcagactacttgggttcacatcccagcttaagatcacttactaaaagtgtgaccacaagtaaattatttaacatctattgcttcaattgcttcatttgaaaaatggggatgataataatagcatctacttcataaggttataagaaaggaattaaaagagttaatacatataacagcactggggcacctgagtagttcagttggttaaatttcagactcttggctttggctcaggttatgatctcagggccatgagacctagccttcattgggctcgtgctcagcagagtctgcttgagattttctctccctctcatctcccacccctacaagtgttctaaataaataaataaattttttaaaacattttttttaatttatttatgatagtcatacagagagagagggagagagaggcagagacataggcagagggagaagcaggctccatgcaccgggagcctgacgtgggattcgattcccggtctccaggatcgtgccctgggccaaaggcaggcgccaaactgctgcaccacccagggatccctaaataaatttttaaaaagaaaaaaaaatacatgtaaagcacttataacagccccaaacacatttcaagtattcaacaaatgtgagctatcaccggtctcatctcctttcaacccgacatttgtattcggtgtttattaacaggtatcatgctagctactgcgaatatgaagacagggttcttatctaacgacataacatgggtcaaggaattgctcaaatgactccccagctagtccaagcttaatggcactagaaatctttttacaacactgcctcagataaatttatcttccaatcttctcttctcttgctttacctcttatggcttatatcctattctggccagactggagtgctctgctctccgtgaagatggcctgtgctgttctgcttctgtctttcctcacaccattccaatgtctcaattatatacttgacagaaatgatgacttacaatgattatttccccaatactatgaatgatgccccataaacatacattacaatttcatctaagtcacatacttaagtattcattcccttcaacatttgctcactttgtgagcacctcacattgaccagttactctgccaagagctgtgaatattttttttaaaaagaatacaatatggggatccctgggtagctcagaggtttggcgcctgcctttggcccagggcgtgatcctggggtcctgggatccgcgtcccgcgttggactccctgcatgggacctgcttctccctctgcctgtgtctttgcctctctctgtgtctctcatgaataaataaaatctaaaaaaaaaacaaacaacaacaacaacaatatgaccgtgttctcaagatcaaagtctagtaatgaaacatgtaatcacataaacaccactcattatgaaaggtgcaatcataaaaggaagggacaccaaggaatgagcagtcagctcaatttgggaggcaaaagtaggctttttagatgatggatttggggctttgattgattggagaagtttattccgtataagagagcagtatgtgtaaaatacagaggtataaaccaaaatggtctgtctggggaacagttcattatggctggaacatagggcccaagggaaagtggccacacacaaaactagacaggactttctggcaagcataggcatttgggctttatcacacaggcaataaggaattaatacaggatttaagcagtagcatatggccagagctgtgtttcagaaagctcagtcctggcagtattgtggcagaggcagggaagaaaatctaaagcagtactgttgaatagaactttctgcaataatggaaatgttctatcactcctgctgtccaatatgacagccactaaccacatgtggctaatgagaacttgaaatgtgactagtgctactgaggaacttcagaatttaatattaatttaaatagcaacatgcgcctagtggccactatactggacaatacagctttagagagagggaaatcagttgggaagctgttgatgtagctcaggtgataggactatgacagaatgtgattcagtaaatacttaagaggcaaaatagtaagttttgtgggtataaagttgtgtgtgtgtgggggaagaacccaagaatgggttcctagattccaggctttgtgactgaatagctgcaattaaccaaggtaatacagaagcagatctagcatgcatagactgcatcaattttaaactggtttaagtgcccgagagttaatcaagaggtaatatttagttccaagtttaactccgacaaatcttttgaacttaaggctcagcatgtgtaaagacacacgtttaagaggcttagagccactgagtgagattagagaagatgaacagaactagaagcaaactaaggcaaaaatcctgacaaacatcatcaacccattagaagaagctagagtccacaaaagaaatgagcagttggacaagcaggaaaagaaacaggtgagaatggccacagaaggggcatctgggtggctcagttggttaagcttctgccttcagctcaggtcttgatcccaggtcctgggatccaggctgtagtccctgctctgcagggagcctgcttctccctctcctgctttccaggtttgtgctctgtcaaataaataaatctttaaaaaaaaggaatgaccacagaaatcaagggtgtagagaatttcaggaagaaaatatgatcaaatgtctaatgtttcagaggtcaagtaagctgagaactgaaaagttcattgtgactgccaatcaggtccttggtgacatctgccagaacactttcaataatggaagaaatggactgaagagtgggaatggggcttagaaaaatttagatgatattttcaggtcttgactgtgcaggatagctcagagtaaatagtctacaaaggaacacagtattggtagggttttccttttttgaggctggcaaaccaatacaggaggaaagtttaaaatactaatgggaacgaaatggaggatagctttagagtgataggctaaagttgaccaggtctaaagaaaaggaattcccttacatccaagagaggatttctagtacaatactaaagggttacaggcaaggcccagtttataggacggagatggaaaatcccgagtcctcccgcagattggctcttctgttctgttcttttggtggggaatagaggttatgaactacagtgaggatttgaacccatacactgagggtcaagggagagattactggctataaacaagtaaaatgtttgctttaggtggcaatagaatcaccataatatccttaatttttatgagattgatttaacatttatagaacagagggcgaagcctcaggaaaaagtagttttaaatgaaatagagcacgagatcagtaaagaagtgaaagtgatcagaaggctctaaattttgtggaaggaaggagtcgaggctggcaggcgtcagtgaagcgatgaagtaagtctaggtaggttcaggggaagtaagaggctgtaaggctgcttaagacaaagatgccggaaaaaacgcccccatctaccgttctcagctcatttcccgcccgcggcaccaggaaggtgataaaccccctttccctttgtcgaaccacaccaggggaaggccccaccctgcaagccctcacatcccctccctcactgacaagagcttcgaggcgcgcgttttttctagactgtacagcgcgaaccaagcggcgacttacacctgggtaagaggaaccaaagaaggctgccccccggcgaacggtgaggccaccgatactgagggaggaggggccgctcagaccagagataagcgcgtcgcgcccgcttccgccccacccactgcgcgcgctctcaggcccagcgagggagcggccgtgcctccggacgcatgcgctctgttgcgctcccccgccgactccaatgctcctttcccctcccccaatcggagctcacccttgcgcctgcgcagtgcacgttctcgggctgtggcagccatgctgagcccgtacggagaggctagtgggggggacggggtcgacgacagcgggataggaagccggggatgtggagaagcagcggcattagagcgccccggctctctggagataggtcagggccatgcagcctctttggcctcttgcgcgacccccagaaaccttcggaaaatgttcctcgggggggggggggggagggacggctggcacgtgacccgggtcagccaatctgagtgttgctgacgtggcggcgcagccccgacgatctccccacccccccagctcactcgggaagggaggggcggggggttacgccccctcccccaacacagcttcggtgtcccgggggggtgacaccccggattacgtcctcttccccccctccccccgcaccaagccgaggggaacgttggctcccccctggaagattccaggttccaggtgagaaggggcccttgggggggcggggatgttgctagttatttagaagcttaaccaatggtggggagtccgggggataattcttggggttcagagaagaacctgagggtgggagggtttgtccttcaaacagtttacagccaatgggagcgtgaagggggggcgagcgggagagggcccctcagatgggggaggggaatggccaacctcgtgcctccgtaccaattggagggcaaaggggcgtgggggcggtgtgtccccccattccattcgtcccctgggggtagaggagtccggagccaggtgaggtttctttttggcggccggaggagagaggtgacctagagggctgaggagtgggagtggtgaccgtatcgcctactcttggatgtgaatgggcaacctaggttgtgaactgagattgttcccgggcgcccactccctgtctccccagactccggaaggagcgtttctgtgcttttgtgtcagcggtaggaagctcgcagtccccacatggcatgctggaggttacgcttcgagtcgcttatcgagtttgtgtgcattcacgtggacacggcctgtggagccttctgcacaaaccgttgcctcggcggggtcttagaaggctcagcatgtgttaccccaggccggggagggcttacaggctgaaagcttggggttcgcttgggaacagaaaccaagcccaaggtgggtgcggggagggctgtagaaagcgtggttcagacaggagcgagtgagtcttaggacctgaaatgatttcacagctcacaaggtttcgggtttctccagggtggcgtcttctgcctcctccatcccctccccccattcctgaacagttctctccttgtgtactgcgggggagggaacgaaaaggaggagagttacttttccaaattcctgactagctgttagcctcccctgtgactcatggtggggtgggggggggaagggaggttgggagggagcagggagcagtgattttccggaatgcgggaaagtaagccagagtaaggtctggctgccctttggctttcaaagacccagcattttcgcgacctcctaagtttttcttcccggccggcccccctaatgggcctctgcaaacttgcgaggcctcgggtggagaactgcagatttaggaggctgggccactagggggaggggtggggggaggggagcaggcctcagcaaagttgctgtgtcattgccctccctactgcagccacccgcgccatcccgcatgtacttgtggggccgaagcctggtccctgcgtgggggagcgcggtggtactaggggaagaggcttccctcccggtgtgcacttctccccgcagggtttgcccgaccgggctggtcgagaagacgtgaggttggcggccattttagacgcagtgaccgaggttagggctcaagagctcctgcgaaaggagggtgatgtggtcggagcgcaaggacctaggccctcacgagcctttccggggtggaggtggaggcgcttacgttcgttgatttacattaatttcctttctcagatatgcagttttctatcttcgtatccagagaaggggagctggagagggagacctcccgctaaagcccaggttggggataattctcccagaaggggtgcgggggttgggcggggggcccagagacggctcgagagatccgggtcttgcattctcggtcttgactccaacatagtctagccctgtgcgggtaaccgaattgtggggaagagttagtgagtgggttgggggagggggcgagactgagctcccaaaatggctcctgcccctcctcggaggcggacagcccggggggaaggggaggaggggagagaaaggagggggagggttaatctgagctgcagccgccgcctccgctcgccctcctccctggcgctgaccgatggaccagccgctccgtggggaggactccggaccctcgtggggggatggggggccctgccgcccccgaggcggagggaccctaagaggggggattcgggcctgccctcggggttggggagggccgggagcttgggaagaggtctgagctcgtcagaggggacttcgcagaacttgttttttcggctctgagccggacaccggaatgaagtttggggcggaggtgggtttcattttacagagaaatgggtatgtttggagattttgccttcactttagggctgctgggattttgccgagcaggcggatactttatgggcaactgtgaagggattggagaagtgcttgggtgtgcgtttggggaatatcctagacttggttgtcttgtgggtaagctaagcctttgagagcccgtggattctttgtgcctttgtcttccgattatttgacctggggaaagggaaggattttttagactgcagcaagcctgtatttttttattgtggagctcgggaacgttagatccttttgctacgttcgggagcccttagttctccgccagagagcaggccgcggcttctaagatggcgtcttcttcctcctttcagattgctcacagcagcggcctcttcgccgagaatcaccgcccgccaggcgtcctgcggccacaccctggcgggccccggctggctacgcccacgcggccccttcagtcccgtcggcctggccaatggaggatctgcaaatgtcacgacctgcccgggcttggcagtcgccggtcgcaccgggcctggacgcctgggaagactttgttgcaaggggaggcggggagaaggcgctgcacccatgccagcctctcttcctggagtcgtcgaaccacagcgcagccaattggctcagagatgtggcggtttgccggttccctatgggtctatgcggtactcttctgcctagtgactgacaccttggaaatgaagcctatgacgtcatcgctccagcgaaccaataggaaacgctcccgcggagaggtgttccgcccctttcgactctgcttcttcacgcgcgtgagcgagcgtgcgcgcgcggagggggtgggggaaatctcgaacacggtggcgcgcatgagcggcgaagctcctcctccctgcctatatataaagggctggcgcggggctcggcggcgccatttcgcgctggagtggagcatcctctagaacgagctggaggattctgcctactgatagccttcgagtcgtcgggggccgccattgcaatccacgtccatccgtttggaaatggccttcgtctcggcctatgaccggtcccggcggacagtacagaccccatagaagcccccgacgctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtccgctgcgggcagtcccagcaggaagaggggatccttgcagatcaacagcgggcagtattgacgacggtgtccgggattgggggccgtcctagtgtttgaggagtccgtccccccttgcccgcctctgctgaggccgccgccattttctcgctgtccgcctcccgcggagcgcgccaagctgctgggagctctccgagaagcagcggagaagactgctttcgtgccggcccgacgggggcgggagttgtcgactggagggccaagggcaggggccctccacccccccacttcccgggttatgctggagcgggcggtaaggggaaccgaggccacccggactttccgcggctgagggcagcgccggttccccgtggtcaggatgctgcaaaacgtgactccccacagcaagtaggttctcgcgatccgcgtgtgggaagatgttgggggctgcggcacggggacgtggagcgtcgggttcggagggaggacggaaccgactcggggctcgttgctattccatggcgcgactgttggcttttgggctcgcggagggggttgggtgacggttttggaacggtggtcgagggccaggtactgcgtatggagggagtacaggttgtccatttatacgttacttttctcgccgtggtccagtctaacctagtcgaacagagctgggttggcggcggaatgtaatgggaaaggacaacgttgagtggggtagccggtcctgcaggtggtgggtctggtgtgtagcaacggtttatcataggtctttcagggtgttgagtggccacatcaagcaccttatagggttgccatggtgatagagcctgactggcgacggagatggccagagtggggcaaagggattacttttcgtctatgggtttgtgtgtccagcttaggtcattgagtattctttcaatgactgagtcagttttgtgttgtgttgaggatttgtttgcatgcgttttctttggaggggatgttttggatagctctgagagttacattcggggcaggagggtggagctaaggattttagtccagctctgcggatgtaaacaatgagatctcccatgtagtgtttgtagttctgggccctgggatacccctggtcgtgactagtaaagagaatgtaagtttgaaccactttggctgtcgattcccagagtctggtgctagagtgggagccgttaatgtaatttttttggcggggtggtgggtggtccatcactatccagctgaaatgtgctgaccttgactggggactgggccgggtctatttttgagtcttttggaggagggagaggaattcgagtaatttctggggtctggcagttggattattccaggccctgaagtctgacaaatgccccccttgtctcaaaatatgttggtaaggttttccgttaggtttctgattcattctctactaaaaattaaacagagcttgtggggaggatgatggtgtgttctcttgtgcccagatggattcttaggtgtctcatcagcattttgtaaaatttgcttcctattttgttccgcttttcactcgtttccctcaggctcaaccaccatggcaaccaccaagcccctagtgaggaggaagcttggggcttgtgcttctttgctccacccatttagcttaagtcccatcctgtaaagctcgtggatgctttgctgttattctatatgagaaattgttttggggctttacttttaaaggagtgatttaaaaaataataaataaataaatgaataaataagtgagtggtaaagcttgtcggaatctggataagtgtactcaacatagggaaataaaaagtgggggaggggcaagaacaaaatctccactgattgttgggatatgctggctgtggttaagatccacttccgtaagcttgattgtttctcaccaaattcaaaacctggatttattgagtatgtagtataagtggcagtactgattttcataaaattacaacatctaattatgcctcccatttcacaggctccctggggaggggaatgcagggttactggggctgggcccagaggcagcagcaccagggaaaaggattcggaagccctctctgttgtatgagggatttgagagccctacaatggcttcagtgccagctttacaactgacccctgccaacccaccacccccggaggtgtccaatcccaaaaagccaggacgggttaccaaccagcttcaatacctgcacaaggtggtgatgaaggctctgtggaaacatcagtttgcatggccctttaggcagcctgtggatgccgtcaaactgggtctgccggtgagtagggatactggagtcgggaggtattgggaatgaagaagaatgtgtgtgagtggaggtgggctgcttagtataggtgctgcggcccctagggagttcccatctctctcctgtagggcaggtagccaccagatatctggattcttggtcctttgtgattattgatccaaccgcttgctatcttggcatctctcattgtgccccctccatgtgtccttccttaacttttgtgccctggctccattttacagattcccaccccaggttgggagaggaccacggtggccaaaattcttagcttcttcctctccctcatgcagcccatggatagccagccccagaggtaatgtttcaggatgggaaaccttgcagagtgggtgggagatgggtggttagggaaaggcatagataggggcctccaaccgggtgttaagaatctcgttccattttttctctgtccttagtttaattggggccgcagtttaggggaatacatattttgcataggggatgtgtatgtgtgtgtgtgtgtttgctggggtcagtagtttgtctaggaaaactggcattttcagtgactgatctagcgtttctttctctaggattatcacaaaatcataaaacagcctatggacatgggtaccattaagaggagacttgaaaacaactattactgggctgcttcagaatgtatgcaggattttaacaccatgttcaccaattgttacatctacaacaaggtgagtttttttatgtgtttattaataggtggagagagagtgcttatgttattattttattggtataatgtttgaaggtgttttcaaagtaggtaggatctagaaaatctgagctccaaaggatacccctgagcacagtgatgggatgtggcttcagaaatctgaaggtgaaggttatttaagtagaacattttcatacttggggatgatgaccctgtttctcaaaagaaatctccagagagatttttgctgagtagagcggaatgtattctccttgagaatctcattcccttacatttgaactttcattatttactgcatattgatggacaattgggaggatatggagataagtagcccaaccagtgtggtggttcttagtaattatgacaaagttggagaggtgatagtagtatttggacctaggaataggaatgcctttgagaaaactgatgtgtctgcctttaactggcatttgaatctttttgtttcctgtagcccactgatgatattgtcctgatggcacaaacattggaaaagatcttcctacagaaagtggcatcaatgccacaagaggaacaagagcttgtggtgaccatccctaagaacagccacaagaagggggccaaattagcaggtaggaagagccgcagttttcctaatggagataagatggggaaagataacagaactaatcttttttttttctctctcccaccccaccccccccacccccagcactccagggcagcatcaccagtgcccaccaggtgccggctgtttcttctgtgtctcacacagctctatatactccaccacctgagatacctaccactgtcctcaacattccccacccatcagtcatctcttctccccttctcaagtccttacactctgctggaccccagctccttgccgtctctgcagctcccccagcccagccccttgccaaggtacagatgtgtggatttctttgggcaatgggaagggaaaggtcttgaatgaggtggaccctaaaaggctcacatcttatttttctctacagaaaaaaggcgtaaagcggaaagcagatactaccacacctactcctacagccatcctggctcctggttccccagctagcccccctgggagtcttgaggctaaggcagcacgtcttccccctatgcgtagagagagtggccgccccatcaagcccccacgcaaagacttgcctgactctcagcaacaacaccagagctccaagaaaggaaagctgtcagaacagttaaaacattgcaatggcattttgaaagagttgctctctaagaagcatgctgcctatgcctggcctttctataaaccagtggacgcttctgctcttggcctgcatgactaccatgacatcattaagcaccccatggacctcagcactgtcaaggtacccactgcatggggcagatgggatgctcaggcagtgattggaactttgggttcaataaaacaatcagtgacttcttacaggcacacggcgatcttgattcttggtattttatttttataaaacaacgggacaggaggttaagtacttgataatagtatttttttgggagttgaaaactgtatggtgagttttgttttcaaagcaatattaatgtctaagtgctacttaagagaattgggttaggggagtaaggggttggaaggataggccacccatccacccctatcacttagaaatggtttttttttctagacgtagatatttcttcaacccacccaaattcctttgacttcacacttgaaccccagagcatagatctttaaggtcatccctactgtgctctcaagagagggctactcttgcggtgtctggggttggcagggaaaggtgagtcttcctgcctgtgcagcttctgatgctgcctccttctgcagcggaagatggagaatcgtgattaccgggatgcacaggagtttgctgctgatgtgcggcttatgttctccaactgctataagtacaatccaccagaccacgatgttgtggccatggcacgaaagctacaggtgagtgtcacagttggaatttgaagaacaaatgagtctggggtagggagctttttgtcctctgctgtaccaccttattgtgaggctgtcccagtatatacagtttgtaaattggagctgtaccttaacactaggtggctgggtgtaatcgtgggaccattcactagtgtggttctgaggatgcctttttccctaggatgtatttgagttccgttacgccaagatgccggatgaaccactggaaccagggcctttaccagtctctactgccttgccacctgggttagccaaatcctcttcagagtcctccagcgaggaaagtagcagtgagagctcttctgaagaagacgaggaagaagacgaagaggaggaggaggaagaagaggagagtgaaagctcggactcagaggaagaaagggctcatagactggctgaactacaggagcaggtatcttgtcactcggtttattttgtgaagttgtttattttgccctaaaatttcttttttactccttttattctgctttatttttctgattatacctctgaatttttggtctccagcttagggcagtacatgaacaactggctgccctgtcccaaggcccaatatccaagccaaagcggaagagagaaaaaaaagagaaaaagaagaaacggaaggcagagaagcatcgaggccgagctggggttgatgaagatgacaagggatctcgggcaccccgcccgtctcagcccaagaagtccaagaaagcgagtggcagtgggggtggcagtgctgctacactaggcccccctggctttggaccttctggaggaagtggcaccaagtaagttataagagagtaggaagcagagaccagcttggctattataatctcagggtggggggtgtgtgtgtgaagttttatctaagccagaggtcaacaaatgtttaattggcaaggtaacaagtactgattttgagaactgtagagttccaaagttccaccctggtggaataatgcaaaagcagccatagatattatggaagcgtgggtttagaactattctaataaaactttatttacatgaaaactagtgactagctagatttgtcttctaatttgttccttctctctgcaccaataaatgcgtagtttttcttgttttccacaagtagtagtttagggagcaacaagatgagtttctgtcagtataccaacatctagttctcaaagcccaaaataaatgtaaagtgcttggcatgtgagaaggtctgttttcctgaggaatattctagtatctcaactctagttggctcaccattacccttgtgggaaaactgaagcttcactctggcaggaaattaagacttctggatttaaatactgggaatgtgtcgggagagattagtgatgcttccctaattgataattttttgcctatatagactgcccaaaaaggccacaaagacagccccacctgccctgcctacaggctatgattcagaagaggaggaagaaagcagacccatgagttacgatgaaaagcgacagttgagtttggacatcaacaaattacctggggagaaattgggtcgagttgtgcacataattcaggccagagagccctctttgcgtgactcaaacccagaagagattgagatcgattttgaaaccctcaagccatccacgcttagagagcttgagcgatatgtcctttcctgcttacgaaagaaacctcgaaagccctatagtgagtatgaaatgaccctttagcacattaatccggcaatcctcaagtaattctgaggacagtgcggaagagggtactagggtatgcttgcagtccggattgtccacttctgaaggtgtggggatttgttggtttcctgatcaggaaaggaactttgccgaagggaaactgggggaaaattaggaagacaaaccacgagagactcctgactggaaaacaaaggattgcagaaggtgtggggggggggcatagggtgactaggtgacgggcactttatggcaatccttagacctggagtgtttcttacttctagccattaagaaacctgtgggaaagaccaaggaagagctggctttggaaaagaagcgagaactagaaaagcgattacaagatgttagtgggcagctcaattccaccaaaaagccccccaagaaaggtaagtattcctgtaaggtactatagatttaccacatccccctttcttgactctttccttgacaaacggagatcagacttgtacaatttacccttcaattttgttacgcagcaagtgagaaaactgagtcctcgtcaacacagcaagtagcagtgtcacgcctcagcgcttccagctccagctcagattccagctcctcctcctcctcatcctcttcttcagacaccagtgattcagactcaggctaaggggccaggccagatggggcaggaggctccgcaggaccggacccttataccaccctgccccgccccttccccccctttgctgtgatacttcctcatctcctcccccctccctcccactgtaggagagctggctctgcaagggggaggggtgcagggacatttactgaaggagggacttaaatggacaaagttaagatggagttcccagccccattgagagtgacctcttgggcatagagcccccattcgaaatgactggggcggggcacgggtacagggtgagagtgggcaaaggccctgatccagggttaacctgaggccatagctgccctgttcacttgtaaaggccctgttttgaggttgtttgttctaatttattttaagctaggtaagtctgaggggtgtggggccatggtcccctcggcctccatggggagggaagaagggggagctctttttttacgttgacttttttttctactctgttttcccttttccttctgctccatttggggcccctgggggtttcagtcatctccccatttggtcccttggattgtctttctttgtctgttgattctaacttgtaaataaagaaaatattattcaaattttgagttaccttaataatgtttgctttgtagtgtttcaaaaggaacgtaatagagtattgaggaaagtatttttgaagtgaggaaaagggaagagacctcttgtggttggattgccttagttgttaccccagtagtaggctgttagctgtgctgataagtcagttcatctactttttataaagtgaatcctaaataacactcaggttcatggtttgttctggtttagtgtttggttttgttgttaagattcatttatttaaagagagcacaacaaaaaaaaataaataaaaataaagagagcacaagtgggaggggcagaggaagagcaagtcaatcctaagcagactccacactgattgccaagcctgacttaggctcagtctcccaacctgagctgaaaccaaggggtgcttaaccaattgcactgctcaggtgcccctggtctggtttaaatagaggaaaagctaagaggtgtctggctcatttgatactttgatcaagtttaggattcaaggtttaagatgggttctgaggttttttcctttacataaaattatgtatgtatggattgtctcctgaacacacttgaaccaaatgtgaatagaatgaaacctaaccacaacagcaggtgtttttgtgttctgcatctgacttgagaaggcagttgtgcttacttttataagctttggcctcaaattccagatttatggccctcgggcacagtacattaatagaacacaaaacagcaattttttgccaaatccagatcacaattcctctccataaatttaaccccttgtcttgctgaggaaagagtctagttcagggaactgggacacgtgggttctggaactggggacttagaagacattatagcctagtaaaacaggccactgcaaaaaatgaacttggaagtgtaagggctaggaatttttttttttttttaagatttatttattcagagagagaggcagagacaggcagagggagaagcaggctccatgcaggaagcccgacgtgggactcgatcctgggtctccaggatcacaccctgggctgcagcggcgctaaaccgctgcaccaccagggctgccctaggaattgttaatgtagagaaaatattctgctctgaataatgttgccagaaaggagaaagtacagggtagaatctgatttggagatggtagtaaagattttggaatcaataaattggactgtagcagggattctcaacccttaccacatgtattagggctccagtaaagctttttaaaaatactgcagtaatttcaactttctgtctttatgaattctaagttgaagcttgggcaataactacccaaaagttcaggagatggtaatgtctcaccagggttgagaaccactgaagtgtttttggaaagcccttagcttgaaaagggacaaagaaccctcagttgggcttttgggccaacttaactgtacaattcagagaatgaatcttggaacttttgagctctgatcttgaagaatgatagaaaagattgaggatgtttttgtggctccggcatctaacttcagcccaggttatgatcccggggtcctgggatcaagccctgcatccgatcccagctctgtggggagcctgcttctatcccctgctagttctcttactctctaaagtgaaatctttaattaaaaaaaaaaaaaaaaacttggcatacttttaatagaatttgttgtgggggtggaataaaatctaaaaaggagtaacatggtttgttagaggcatgtatataatatgtccaggattatatctcatttcaaaaagaatacaaagtgagttggattagttgagggtggaggctagctgcagaatcttaaggtagtatggctgcgttgccttgcattcgtatactcttaaagactagtctgggaaagtgaatttcagctatcaaaatgggagtttctgatgtctttggcagctccttagaagtataacctgaactgggaacaagtgctgtcagaatgggcagattggctcatccccttgactgcagaaccacttgagacggaaagagtttccagacctgtgttagacttcctactctgccatatcaggccattttcaagtgtacatggatttcctgagactcaaagttttttggtagagtccttgctgtggtctctgacccatagtttggtaaatctgtcctttgatttactttctcccctcagttgaatttttcctggtccaagtcccagctttatcccatacgctttaggcatggtaatagttttgaagaggcagagtggtagcttggttcaaattcctgtcttccaaagtaaccaatctgtagcctaacaggacacaaatgtggagtcctgtgggtatccctcccatgttcttcccagctcttgaaatcatgggttccactgcctgactcttaggccatttgctctaatgtctcctgtgggagcttttttaatcagtcaacacattttacagagttccttggttgccttttattttaacaaccacgtcaatagaccagacacggctaagctctgccaagtcgagcatggggttgaaaattagagcacaagccctgccctcaagaagcttgctctgtcaaagttgaactcttaacacgatccatatatggtgctgatggtctccaagataaaggcatgaattggtcttcccagatacttcctgcttattagagtatgccaatgtgtggatcccagtctccacccctgccaaccttgctctcagaactatcttgattggagttattctcctggtctggccccaaatcaccttgagagaggtgttcctgagcagtgagaggaactggtagagttgggtaggggatgggaatggtggtagggaactgaactgatgtctcccaggatctcccatctttgtttctttcccctttactggatcctaagtttaattcaagctctgcaaaaccccactagctggtctctagcactaaatgagacagcttgctgcacccatagtgtgtgggaggacaacattaggtaatcacagtttttaagaaaaagtgtacttctagcctcacacatgtaaaggtttttatgagcttagagagatttatagattttatttatttatttatttatttatttatttatttatttatttatttatttttgagcttagttcttattctgagatctctcatcagatctgttctggcagatttcagaaggatgaagtgttaggctatatccaggaggaaggggagcaaatgaggcctgcagaaaaaatagtggaggtaaactgcagaatgcaggcagtgctgaagcaggagtgaaagggtgagtgcttctaggtaagaccagaaaggcagaactagaccaaggagagcagttagccatgataaggatttgaatttttatccaagactttaatcacagctcacatttaattgagtactgactatgccaagcagtatgcacaactcattttgtctttttttttttttaagagtttatttatgagagacacagagagagacagagacgcagagacacaggcagagggagaagcagtctccatgcagagagcctgatgtgggacttgatcccaggtctccaggatcatgtcctgggctgaaggcagcgctaaaccgctgagccaccagggctgccctcattttgtcttcattatagtcctgtgaagtagatctaatctccaacagatgaatgaggcacagacatgctaaggaactccccaaagttgcaacacagctggtgagtgctggggtgggactcaaatccagcaatctggctacaggaaatactaccctggaattccagtacaacaggctggtagggtcctcacatcctttgaaaaaattgcagtgagaaggatcatgttgagttggtggggtgtcgagaagggatggagagtgattatttagaaagcagctcctacaaatgaggatggtggtttggaatggagaggcagcaatggaggtgaaaagtaggtaagtttgaaaattgtaggagatagaacacatgggactattctccacacaccacaggaagcgcagttgtgaatagctccgtattccttggagtccagagtgttccagccctggaagtttgacagtttgttaactaaaggaatgccagctggctgactggcaagagtgaaggaaacccctcaaggttgcccctgggtgttggggttggggggtgctaggtttccgaggcatttgttgagcatcccagagggtctttggcgccacctggtgagcatggtgcccaggacctcgtggatatttcaggtagtattgtgcgtaccctctcatctttcagttcttacttccctgtacttcaacttttgaaacatcagcctcacttttatgaccaggaggtctttatttgtcttggcctctgaggcatcccatgtggcttcgcctggctctctcactttttaggcagcctctcttagtttgcttctcaaaagtctctacctccaccttccatgagatgttgtcatccttcatgttaccttccttggtcctcttcttatttgcacatttctaatcaattctacccattcttctggaggcaattcccacccatacaatctgtctctgtccagaccttgctccaaagttccaagtctgttttcaactgccaaatagcaatgtcccaggagcacctggcactcagcatatgtccaacaacgatcccatcctttcccacatagatgcctctgtgagttacctgtttatggaacaagcaatcatacaaaactcactaatgtcctggacacttacaagggcccttgccgtcaagtccttccaagaacactaggacttaggtacccagcacacttttatagatgaggacacagagctatccaggaacagttctacagtaaacaagtggcacagccaggattattaatgtaccaccattcccttagtcactggagccagagcctggtgatcagtccagatttctacccctcaccctccccttctctgttcacccatcaaggcgtgtggagccttcctccatcacttctctcctatcagtatgaccccctcagactggactatcacaactccctgctcaccagttttctgtccagtctcatttccactatccatcccccacgctagctgccagagagatctcttaggacagaaatctgatcatgttgcttattattactcttcaggtttaaacttctttgccaggtctctaacctgtgttgcttctacacagtgatatttctcatttgcccttccttaaactctgcactcaactcagagcaaaagataagccttcccagattctcccatgctgcttagaatatcctttccccatcagtaaatcctgcataatctccaagaaccacttgttatctccactataaagacctttctgactgaacttccataccccatgacacatacacacactttcaaggacctcattgagcttctaactatgccctaagccctccccacccaaccaataccctttccagactccagcgggggaatgtctaacactgatttaaattggcctctctgttatggctgttctgctcagcagccttggaggaatgtccttatgaacaattagacaacttcaatttttcagttcacacttaagcacttcctcctcaattttgccccttccacttatatgtctcttataggtcctttgttaggcaggaattgtatcttgttctttataaacttaaccttaaccagtgcctagggaaacaatttacatgtaaaaataagtgatggttaaattacctcttggcatttgcatccatcccaggcacctcagcacacatcccgcggggctagcaggcgtgggtgctgaggtatggactagcgtagtatcaagtcactggctccagtgactaattatgcaggatttgctgatggggaaagaggatattctaagcagcatgggagaatgtacggtcaccacccacccctgttttgtccagagctgactagctttagttataaatatggggaaatctcaggcgaattgggacaagtggtcacctcatgaataggagacatcatcactttggccatgcaggcagatagtaagaggtaacatactctaggcatttttttattttccaggccctatgcttattttattgtataactcatctgattctcacaaaattgaattctttctcattaaattttattatgccctcttcatagaagagaaagcagaggctcacagaggtatattaactgggcctgaatctttgattccaaagtctgtgtctttgtgctgtaccatgtggtcttggggttccatcaatcaccttctcccttcatgccccgccctttgtgcaggagccctccctccctggggtaccaggcaggcctgtcacttgcagtgaggcctctcatcaacctaaggcagccaggataagaatagctccttgtacaagtgagaggaactagcaaacacttatacgtaatattcctcatgtgcatctaccaaacaaggacattgctaacactttgtcggctaagctaatgtctgatttgaggttggaatagaaaaggcatttattctccagggatacgaatttttgccaggtgttggtgtgaaagagttactaaagtactcttcgactggttccgctgtcagacctcagagtcagctgctgttaggatttctgagaccatgagaatgcaacagagcccaatcaatgagtactttctcctcctctgcccctgcggtgtgtgtgttggaactggctttctccgtggaggcaggttgtagagacacctctgaaagttcctccagaaatggttattacctatcctcctgcctcgtctctgcgtctcacccagagttgctgcaaaagggagacgattttctctcaaaaaaaatgaaaacaaaaacaaccagtttttaaggttttctaagtttgcacgtgtgctttttttaactctaactccagggcaacaaaagctgaaaagttacggcgatgggggcaaagaaggctccattccttttttttttttttttttttttttttttaaatttttatttatttatgataggcacacagtgagagagagagaggcagagacacaggcagagggagaagcaggctccatgcaccgggagcccgacgtgggattcgatcccgggtctccagaatcgcgccctgggccaaaggcaggcgccaaaccgctgcgccacccagggatcccagaaggctccattcctatcaggaacctactgctctttaatgggacacagaatgtcacatccagtggtgacagaaaagtgttgttgttgcttgtttgttttatctctctctgcttattattagggatttgtgggctttcatatattcaacatgtttaagttgattatagtcattttttgatgctcaaattcccccaaatttggccaatggggaacctcttcaagctggctgctcttctcttttgacatgcccctaattagtcttagaacacttcattgtttgctgaaacaaatttgctttgtattttccctaacccagacctgcaatcagtcacttctctaaaaaactccatttccttttattaggtatttagaaaccacaatctgtgcacttggatgctccttgctactgaggtttcctgtatcactttcaggttctctcagccactggaactaggagatacacatatttatacatcattaattaaaactgacttttttttttttaagagcacaagcagggggaggggcaaagggagaggaagaagcagactcccctggtgagcagtgagcccactgtggggctcccatcccaggaccctggaatcatgacctgagccgaaggcagacacttaactgactgagccacccaggcacccctaaattcatttctaattaaaatttaatattagtgttttaattcagctacttttttccctttaaaagtaaaaagacattaaaagtctcagttccaaaaaaaaaaaaaagtctcagttcctgggcagcctgggtggctcagcagtttagcgccacattcggcccagggctgatcctggagccccgggatcgagtcccacgtcgggctccctgcatggagcctgcttctccctctgcctgtgtctctgcctctctctctctctctgatgaataaataaataaaatcttaaaaaaaaaagtctcagttcctaaaaaaaaaattcttggttcctaattacattacactagtaattactgattggttaatatacataatataatttcaaaataataatacaatattaattttttaaagattttttttatttattcatgagagagacacagagagaggcagagacacaggcagaaggagaagcaggctccctgcggggaacctgatgtgggactcgatccagatcccaggatcatgacctgagccaaaggcagatgctgaaccgctgagccacccaggcatcccaatgcaatattattattattattattattaacagtgaaactactcaatgacattcaaggtttttggtagttctttttgtccttagcatatattccactaagaatatacagtactgtcttcttttttttttttttttttttttatgatagtcacacagagtcgcacaaaccgctgcgccacccagggatccctagtactgtcttctaatattagttaaactctcttcttggtgtagtttacttgtttctgatagttttaaattttagggttttttaaaatatttataaaaattgtaaagcagggaagcccagatggctcagtggcttagcgccgccttcagccccgggcgtgattctggagacctgggatagagtcccacatcggggtccctgcatggggcctgcttctccctctccctgtgtctctgcctctctctctctctgtgtctctcatgaataaacaaataaaatctttaaaaaaaaaaaattgtaaagcagggcagctggggtggctcagtggtttagtgccacctttggcccagggcgtgatcctggagtcccgggatcaagtcccacattggactccctgcatggagcctgcttctccctctgcctgtgtctctgtctctctctcacacacactctctctgtctctcatgaataaataaataaaatctttttaaaaattgtaaagcctttatatgtttcaaaagtcaatattcatttttatccctgttttctcaaacccattccttcaattcttattctcccaacttcatttttaccaatttctggttttatccttctagtatggctttttgcaaatatatatctctgttctttcttaccccaaaggtagcacatactatatataattcctttgtatgttgcattctccatgacatcctagagattcctccacaggagcaaagagatcttccttgttctgccaacatctttagagtaatggtatggaagtacttccactgtgtggaaataccatagctttttcaactattccactcttactagatattgttaccaatctttcacttacaaaaaatgacatatcagtcttaaaaggcagataaagtctacatgtttgacatttccttatacatattaaagtatatttttattttttaaggatttatttatttgagagaaaaaggtgcacacatgagagaggggaggggcggaaggagagggagagagagagagagagaatccacaagcagactccccactgaatttggagactgatttggggcccgatcccatgactctgagatcatgaccagagccaaacccaagagtcagctgcctgactcagacacccgggtgcccctaaagtataatttagaagaaaaatattacttgtgtctatttatttttagttcagtttttagcattctttggaatacttgaatttcatggaacaatttaagaaacaccaggtatatttcacggtgagcatacagactaatggatcggacaaatgtcaggtcttcagactagtgcttggcacactaacagtgcctaataaatgaaggacaatcatgataataaaagcaatagtgttaataacagcagccacattttaattacaggctaccttccactagctcgtgagtagtgatggttcagcagaaggaatttgggctcctgcatcacacagaccttccaggccaccttttagatgtctgaccttggggcaagttgtataatttttcaaccccagtttccttcctcccctgtaaaaaatgggtataattattctaactttgcaagttgattgtaagaaagaaataatacatggtaaaggaatattgcttttcttttcttttttccttctctgtactgaagtctgtgatatagggcgatggcagatgtcacctccaagacctctcctcttctggcattgaatttcccaaagcctggagcacactggacatcacgccaggcgtctcagacattatactaggaagatagagagaggaatgactttgagaggcagggaggcaaggcagagagggtagattctcctaaactgtggaaggcacagtggtgggtgggtcccgcgagagccccgttaccctgcggcacccaaagcagatagggaggactctagggaaaagaaagggtgtccatctggtgcatttgtgcagtcatgctccaaagcactggggctcactcctcaccaaaacctcccctgccccctgcctgatgcagaacagcaagctgccactccaaaaggactatctatgcaagcgaaggcccaggcatcctagagagcgccagtctgaacagatgtaggaagacagggagctggtctaatgccgcagcgctgtgtcagtgcctttgaaaaaccatgaaagagggggcgcctggctggcttagtggttgagcgcctgccctttggctcaggccatgatcccagggtcccagccagtcctgcatcgcgctccccgcagggagcctgcttctccctctgcctgtgtctctgcctctctctctgcatctctcatgaataaataaacaatcttaaaaaaaaaaaagctgcagaacagtgggaataggccaaatctgcaaaaaataaaatggaattcagtagaattctaccaatgtgttaatgcccagtatgttccagataagaggttaagtgttggaaagatgaaacacagccttgccttgtgatagaagagcagcaaaggaagacacacacacgcacacacgcagctaactctgacatatggcagaatgtcatagatcctagtgagaaaatgggcaaaatattgtggcctgggattaggaaggtttcacagaggtggcattgaatttggactccggggaggacaggtaaaatgtttggttggcagaggcaggcaggtccaagcagagaacagtatgcgcaaaagcaggaggtataaacatatcttgagagtttggtgtgacttagcagtggctgttttcaggggagctactaggaataatgttaaaaagtagattgaggacaatttgagaaggatcttcttcaccccataagaatttaaagctggaagaagagaaaaagaaaatagcctaaaagcttccagaaagaaaaaacaacagatcacatacaagtttcaggactccaaatatcttttggcttctcagtaataatactggaagctaaaagacttatagggaagcagtttagcgccaccttcagcccagggcgtgatcctggagacccgggatcgagtcccacttcaggctccctgcatggagcctgcttctcctgctgcctgtgtctctgcccacccccctctctctgtgtctctcatgaataaataaataaaatcttaaaaaaaaaaattctgatagaaatgattttaaatcttgaattgtatgcccaacttgtctcattcaagtgtcagagtagaataaatcaattttctgaaacgtaaaacataaaaatgtgccttttatgcactctttctcagagagctaaaagaggatgtacttctgcaaaataaagcatagaccacaaaagggtaattactggatttaagaaacagaagctgccgcacacaggacaggtaaatcctgccaaggatggtgaagggtgatcccaggatgacagccatgtcactgaaggcagctggttaagaatggagcagacggaaggtggtgggacagttttatctggcaataaaatgggctgattgtgttgtaaggaaatttgtcattcattaataataagtacaaacaaagccaagcaaagagaaaacaggataattattcactccagggaagacaaaagctgtttagggaaggaagagcctggcttactctgtggtttgactgcacataacttttacgtggtcacagtaatataaacactgaacactgacctagccagagcgaccatctaactaattgtactaagggatgacagcaccagaagagggcatgtgtgtggtatgaggatgaaaatcctcatcttccacagtgtgaggcaaagagagaaagcctaaggctgaaaaatcaagatgtagcaacacaaacacatgatttagagacaggaggtaataccaacagaatcgatcgaaaacagttgaaagttggggtgcctgggtggctcagtcggttaagcctctgcttttggctcaggtcatgatcccagggccttggggtcgagccccatgtcaggctcccctctgcttctccctttgctcctccccaccccactcattatctctctctctctctctctctctctctcaagtaaataaataaatatttttttgaaaaaaaagttgaaagttatcacttcttggcagggaggacatggtaggagcaggggctggagactagatgttttggggaaatcttgtagaactatttgactctttaagctatatgtgtgatgatggcccaggcacctcagtgcagccacactcccagggagcaggtggccagtggccctccccagggactatccagcaggcctggaggaacaaaagtggctctaagtccagcacaggcacatcgaagaaagctaaagcacttcatgtgaagcacagatgcagaataagtgtcagatagcaagcagtagccggtccacgtttagtgagtgggcagcatttccttctcccactggtgccgacatggcagaaattggtgtaattcagtctaaaatggaatacagcgaacatattagttagcaaatgagggtcccagaaaaattaaaggtagaaccaccaaatgctgccctggaataaggagttccgaaggctgctgtcattatgcaggttgcagagaggactgtgggagcaggaaataatgaagacattccacttccaagcccagcagatcttgatcttcatccatcagctcccaggggaacctgggtggctcagcaattaagtgtctgcctttggctcaggtcatgatcccggggtactgggatcgagtcccacatcgggcttcccacagggtgggtgcttctccctctgcctgtgtctctgcctctttctgtgtgtctctcatgtataaataaataaaaccttttaataaaagaaggaatttgcaggaaataaactataagtatgacataactttgttaaaaattacaattttccgtcttatctgaggaaaatgaaggcactcatacgaaaagatatgtgcaccccaatattcattgcagcactgttgatagtagcaaagatatggaaatgacctgagtgttcatcaatggatgaatggaaagataaactgtggtacatatgcaaggaaattatgtagctgtaaaaaaagaagatcaaaatcttgccctttgcaacaacacggatgggtctctagggcattatgtgatgtgaaataagccagagaaggacaaataccatatgatttcatttatgtgtgggatctaaaaaatacttcataaatatggggaacagactggtggttgtcagaggcagtagttggggggtgagtgagggagaaataagtaaaaggagtccaaggtaaaaaggggaaaaaagggaaagaatagtaaggagatgactaatgcatttagttaggaagaacaaaactgcaggcatgtgaaaaagaaacaaagttctgggtaaagtaacattattttctctcctcctgggtgtttgttctgcccttaggccttgcttctttcttactgaaacactcattcctcagatctctgcttgtcagtcttcggaaataacatttctgtcccggtgtcacctcctaaagtaggacttcagccctctccttcagtcactctatcagaccctttattctgtttaattttctttgtagaactcatcacaatttccaggcctcgtatttctcattaaatatccttttcgctggtggtatgtttccttcactgagtctaagcttttggaggtaagagactatgtctggctttttcactcctgccctcaatcccacacctaaagcaacaggagacacttagcatctgatcggatggattgatgcataaatgaatcaaagatgcagtaattcacttgactacaatgggcctgttttattaaacacaaattagagctatgagtattttctcaagcttcctttggaacactgcatagacattcctaatattaggaattatccaaaatgaataactgcattcagctctagtcttctgaaaattctgaggatgtccatgtcttctctgcacctcctggtccatgcagtgggtcatttatccacattaaacctagaatatgttagaatattaaaggcatgggctttggagtcaaacagacttggattttattccctgctttgacacttagagttgtgttgctttggacaagttactgaatttgttcaggcctcaatttcctcttatttaaaaatggaataatattagaatctaccagatgggattattggggattagaagatacaatgtatgtgcactgtatgctacacagctgaacagggaattgtgggggagaaagaaagagagagagaggatcagcagaagggatctggaggcagcccacccagaagactcattcagagagaatgggaggatcttgcaatgttggaggtggggggtgggttatacaacaaggaggagatttatttattttttattttattttattttatttttaaggaggagatttaatgttctcaatatatgagagccatgatacgtcatctgtagggagaacctgcaaagagggagagtttgaaaatacagaataagagttatctattgaatgtctattctgagagatacagaaaaggatcagatcaagaatatagaaggaccaccagcattttccacagcgctagaacaaacaattccaaaatctgtatggaaccacaaaggatcccaaatagccaaagcaattctgaaaaataaaaacaaaactggagacatcatgattctgaatttcaagctatatcacaaagccatagtcatcaagacagtataagtcaatggaacaaaacacagacacataaatcaatggaacaggataaataacccagaaatagacccacaactctatggtcaactaatctttgacaaagcaggaaagaacagccaatggaagaatgacagtctcttcaacaaatgctgttgggaaaagtagacagcaacactgagaagaatcaaactggaccacattctcacaccatacacaaaactaaattcaaaatggttgaaagacctaaatatgtaacaggaaaccatcaaaatcttacaggaaaacacaggcagcaacaacctctttgaccttggccatagcaacttattagatatgtctctggatgcaagggaaacaaactcaaaaatgaacaattggaacttcatcaagataaaaagcttctgcacagcaaaaaatcaacaaaactaaaaggcagctcactgaatatgagaagatatttgcaaatgacatatccaataaaggattactgtccaaaatatattaaggatttaccaaactcaacaccccaaaaataaataatccagttaagaaatgggcagaagacatgaagagacacttttccaaagaaggcatccagatgtctaacaggcacatgaaaagatgctcaacatcactcatcagggaaataaaaatcaaaactatgatgagatactgcctcacacatgtcagaatggctaaaattaacaacatgaagaacaacagatgttggcaagtatgtggagaaaggggaaccctcttacactgttggtaggaatgcaaactggtgaagtcactctggaaaacagtgcggtggttcctcaaaaagttaaaatagaactaccttaggatccagcaattgtactaccaggtatttacccaaaagatacaaaaatacaaattcaaggggtatatgcaccctgatatttatagcagcattatcaacaatagccaaactatggagagagctcaaatgtccatcaactgatgaatggataaagaagatgtggtatacacacacacacacacacacacacacacacacacacacacacaccactggaatattacttggccaacaaaaagaatgaaatcttgctatttgcaacaacatggatggagctagagtctattatgctaagtgaaataagtcagagaaagacaaataccatatgatcgcacgctaatgtggagtttaagaaagaaaacagatgaacatatggaaaggtggaaagaaaaaaaaggacagagggaaatacgccatatgtgactttttttttaagattttatttatttatttatttatttgtttgtttgtttgagtgaatgagtgagtgagtgagagcatgagcaagggaggagcagagagagaagcagactccctgctgagaaggaagcctgaagtgggactcatctcaggatcctgagatcatgacctgagcttaatcaactgagccacctaggcacccccataaatgactcttttttaaaaaaagattttatttatttattcatgagcgacacacagagagaggcagagacataggcagagggaggagtccctgcagggagcctgatgcaggacttaatcccaggaccccgggattgtgacctgagccaaagcatacccaagtgactcttaatgacaaaaaacaaactgagggttgatggagggagatgggtagcagatgggctagccacctagcctaaataaatgggtttatttagggagcgcacttgttgtgaggagcacagggtgttgcatgtaagtgatgaatcaccgaattctactctgaaaaccaatatcacactatatgttaactaacaaaagttattttttaagattttatttatttattcatgagagacatagagagaggcagagacataggcagagggagaagcaggcttcctgtggggagcctgattcaggattcgatcccaggaccccaggatcacgacctgggccaaaggcagatctcaaccacgagccacccaggttctccctaactaccaaaatttaagtaaaattttaaaaagaaaaaaaaatgtgggaggacaatttttaaagtgagactgtttactctgaaactagaagaaaaatgtgcttatgaaggcagatactaaatttaaaagatttggaattgtcccctgaagttccaatgacttctgtgtaatacatgcaaagcaaaaaagtagacttctggtcaaaataaaacacttttaatgaccttattaaacattcgaacagtgatcagagaaacatcttttccaaggatgatcaaattaacttttaagcaaaagatcagcagagatcaaggcatgttggggtcaaacatatcttgaggtgtcttctgagaaccaacacattcttctttcttttgagaaatgatccaacaacccctttcctcagaggggtttgtgccttagatcttctgcctctggccatggtacattggactcagatggacacctgccccaagtttgggcattcatttgtttttccaataatttaaaattgtcactgggagatagtgctgttgggtgggttcagctgaggtgctgtggctgcgggcggacatgttagatgaaaaggatagtccacagagacagaatagatatggctaatgcaactaacatgcagagggacaacacaggccatatggcccagagagagaaagagagcaagaaaggatatgggctatgggctagagtctatgggcttttcagttctgagttctgttgcctgtaaggcttggctaaaatccacctttgggttcagggcaccactcctgtgtctttattgtaaatatcctctgcttacatctgtgatcattttaggagggtttctgttacgggcaaacaaaggcttcactaggaccactctcccccttccaacagggtcttcttctggccgttgattcctttcaacttactctctcttgggaaatctacagtgtcttcacgatctcttagtttctttcctctctatgaccaaacctcacaatgccaaacccaatttgcccctacttacttgtatcttccccaactcctatgccctaaaagacccaggttcccagaaagccttcctggaccacctctgaactcagggatccattcttagcatcaggctatgtcagtgggtcccagttatcagatcacagtctaagttcaggtggctgcatcagcaacatctgggcttgtttaaaattgcagactgctaccactctcctcaccctccaagattctaattcagtagatctggctgaagcctgtacttttaaaaaggctcccaagtgattctcctgtacattccagtttgaaaaccactaagaaagatccacctgaactctgtctaaaccagctcttctactggtatgactgaccccaggttaaggaagtaatcatcatatccaagccttggacctctctttgtcatgcgtgggactccaggggatgtagaaaaaggagatgacattgtagatcatggctgtataccaaagttctcttcattacagagtaaatctggacaagagtagaattcccatgaacatttcctctcctgaaaactcctttaggggcaaatctgaattcagaaggtaaatttcatgaagtccttgtgagaggaccgattcataactaacacaccatagagactcaaacagaacaagacatagctgaactggcctgaggatagctgcctatccccgttgaaatgtcctgctcaatagtcatcacctggaataccctcttccagcatccctcacaccctggaagaacttgccaagatctgatagaaatgatacagtacaaacaccatttaaaaatttattgccactaaccagagctttgggtagaacaagaaagaggtgtgtgtgtgtgagtgtgtgtgtgtgtgtgtgagtatgtgtgtgtgtacgtgttgggggtgggaaggggagctagctgctgccccaccagtcctgcagtgagtaccaggtctaagggaggagacagacctatagcacagagtttgatcccatccaaagtcagcacaatagagatatacttagtagactgaggcactgagtatgcaaaggctgtcagaaacttgcaaggaatccatagagcatctcccacaatcctttctcggaaggctcattacctaaagtggtaaaaagcatataatcaagctcacaatgctgggatcctatctctgattgcccacctccccaaaacctcaccccctcatcacttctactcttctattccctgcccgctacttgtctattcacccttcccattggccccattgctccccaaagaatgatcctgcaccccatcctgttcagagacacccactctcctgcccccagactcctgggggcctctgtacctggggccgctggacaagcacgtgcctctgatgatgaagatggtgcccacaaggaagcccaccaggccgagagccaggccaagtgcacagatcagagtctcgatggtgtctggcactgggataggcacctggggctcttgggggagaaaggaaaggtcagggggttcagagaaaggattccagagcaaaggaaacatgggtctgtggagagtgacctggtgaggagctccgtaccccagtgcctgagaagcggctcttccagaccccagtgctccaccttgcagtcatacatgtcttctgcagagggcacgaaggtcaagtagcagaacttgcggaacagatggtcaggctgggaatagaagctggtctgggctaccccctcgctgattatttgaccattgcgcagccaggtgatattgatcacaggagggaagatgttgtccacaatgcagatgaggacattgggctggcccagctccactcgaaacttggggagtacagccaccctcggaggcactaggaaaaatgaggccttgaattccaaaggctcatccctgtacctgggcttcattaggacttggattaagtaatgtttcctcctatttagccatttacagggaggaaatgctctgggatgtaacagcttgggtgggaggggtgcagagggagaagaggctgagaggggggcacctggaacccctgtatctgacaggtccctgagagggcatccaggtggaagggtcagtcctcaagaaggaagagtgtgctgaaggggtctgggaagatcaagagcctcctggaaaagaaaggggctgattacaacagtcacagaggctgagagatgtgctggagcagatggaggcctgtgaggtgggaagaagcttctctgggcctcccttgcctaacacagggtagcagagggaacaaggagaggaaaggtgggtaccgttgatggctctggtgcggttggagcgttccaccaagacatccaggtgggctttgatcaccgcgatgctggccagcccattctgtgggtcaaagtgggccaagttgccaaactcaggcaaacgccacacagcctgcctcttcttcagctccacggagaacagctgttccccatcaaattcatgggcaaactgacccgaggaaccataggactggtagaaggctggtccataggagcccatgtgatcagctgtattgagtgagttcagggtcagagacagaaaagaaaatgtatcaatctcatctaaagcaggtgacactttaaatttctgagcctacatcccatcctgggttctctatgagggcaaagttgagctgttgagctggtctttggacagtggaagtgttgctggcgggggggggggagaaaggagaggacagagggacacggacatgtgcccaacacactggcaggaacagagagacacgagtgcagtccagcataccaggttgggaagaagagaggctgcctcaaatcatgcttgggattcaaagttaaatggtagccatgatcatcagctctagttgtgctatgaggtcctgtgtgtgagatgagtggtatgagggagtgggatgagggaaaatgattaaggatgggagcataagtagagccttgggcacagagatgcagtatatgtgggcaggaggggagaataggtgatggctggcagaagtaagaattaagatttgtgacagagatcaaacagacaggaaaaagcagcctggggtattgcagagagcactggaaaaggagtccaaagttcaagttaggtttatgccccagctcttccacctcaagagattatgatccaaggtgtctctttccataactgaggcttagttctctggaaatttgggttagattttaatcagtaagggacctctagaaatctatgcagtcatcgagggactactatgtgcccagcatgatgtcaggccccagggaaatacagatgaaccagctgtggatccctcactcaaggagctcatgtctagagcaggataaacagttgactatccacatggcgataaacattgcagtaaaactggacctgaatgcgcacactccaagtcaggaagtgacagaaaagtcactgtgcttggcggaaggagaatggaggtttgggtctcagaaagaaggaaggagctggggaggcacctgaacctgcagctggcatggctacactgagctgcacctgtatgtttaggtctgcaatgaacatgatagaggtgagagagattgaggatctctcggtaaaggaagttgcccataagccagagaaggagaacaatctatgttctttctatactgtctctcatagaaccctaaatttcctttcctcagccgatccccctcagcactcaccctcgatggccccagtttcatgggggctcaggaggctcatcaaggtgtagagtaccaggaccagccccctactgaggaccattgccctggtgctttaaccaagtaagtctctcagagtcgggctgccgcagaaggtaaagaaaagaggaaggaaacactctaggatggggaagacccctgctgtattcagccaatcagagacactccttgagttaaagtggctgttgttgggtgaagaagtaaggagcctaggtggaaggtggaagaatacactgggccctcattgcaccacggaggcctggtccacagaagagtcaaaaggaagcttctgtttgggagatggcagagctttaatcaaccattactacaaactctaagaagagacccaccaaaggaagagaaaaggccatcagagaactacacagctgagctcaaacaaagcctctatcttgctttgtgatctgtggtgtagagaaacccagtccccctctaagtttctgcagacacatttggaggcaataataataataataataataatataaactgtactcaggaactttgaaaaggagatgttgaatacacagtaggattaaaatcctttaaacctttaaattgttttggaaaatattactttatttcattgtgtgaaaaaaaagtgtaattgtcagagatgtttagagtaagatgtttagagtaaggagaactgtaagaagcctcaatggactgttctagggggggcagagggtgctggataacctccatttgtccctccaggtctcctgggcaccctccttcatgctgccagcatccccagccccagcccccgtccctcccccagcaacagcaactcctttccctcccgcttccggttgagctcagccaatgggaggcgggaggaggatttgttctaatatgaaaactatatataaagctaaccatctctccagataaggaaaagtctaaccaaatacctgaaggcagtttctgaaagatcagaaaataaatgattttctgcttggaagggaactaagatatcatctgagtctatggttccaaaccccgctacagaggagaatcacctggaaagttggttaaaaatgtagattcctggggcgcctgggtgactcagatggttaagtatccaactcttgatttgggctcaggtcatgatctcagggtcgtgagatggggccccgagtcgcactgagcgtaaagcctgctcaggattctctttctctctctccttctgcccctcccccttctctctttctctctctctttctcaaaaagtaaaataagttttaaaagatacggattcctgggttacatcctgacctgagttaaagcagccttttcaagggtagggctgagagacctgcgttagtaacacgctccctaggtgaggactaccacactggaaaagaaccatgcctcctgctttgcaggctagagagaacctccagaaggatctgaagaagatcttgcagctttcgaccacaaaccacatgccatttctactcacattccattggcaggaattaaacaatgaccctgcccctgggcagggctgggaaaaatgtattttagcggtgcgttcaggaagacgtagtggttggggagcacatcgcaggcactatctttgccccatccctgctctatttattgtgattattaacatatttgaacctgtttctaatattgtatttatttcaatctttccatttgttgttgttggttttttccttaggcttcatcatctaaaaaaaaaaaaaaaaagtgttatttttaccttacctatcttccctctagccagataagaactttagcatgctttcaaattattcatatactgcctctctacttcaccaaggagtttgatcaactttacttctcatcctttttggcaccccctgacatttttttctcctttattggaatacttcttccaaaaatgttttaagtatgagcaaatcttctgaagctttgtatgcttgagaatattactgttacagcaccacttgtgaacgtttagctatgcattaaattctaagttgagggactcctgggtggcttagttggttaagtgtccgactcttggttttcagctcaggtcacgataccccttgtatcttttactctagaagagttagttcttcaatgtagtcttcccattactctgttgtttttctatctctcccactatttattcccagtagtggggtttttgactttcatatttttttcatgcctagaacttctatagagctttttctgtattcctttttttcatattataatagtttttctttttttttaaagattttttatttatttactcatgagagacacacaaagagaggcagagacatagacagagggagaagcagcctccccccagaagccttttgcaggactcaatcccagaaccccgggatcataatctgagccaaagccagatgctgaaccactgagccacccaggcatcccagtttttcttattttttaatgtgtttttcatgctccttttaagtggctatcctatattttctaatatttctttaaggacacatatgggctctctgttgcttttcttttgacatgtgaaacttcccaaaagggagggagttattattttggccttcaggtgcccatctatgtcagtatcatggtaaagagagggaaggaccagagttctaggacagcacaaaaccagttgccacccttttggtgtcaccttactggtggcagttcaagtcagggcctcaggataaggagccctgggaggggctagtcctctctccttgtccgccagccctgaggacggtccgaaggagtgctgcagagtgaatgactatggcatcaggtgcacttattgtcctgcaccctccccactctagcagggatttcaacctagactttatccccaaccctctatctccaggcatgatccagcaatcaggatcttgggccactgttttttgttgttgttgttgttgtggttgttgttgttgttgttttttgcattatgggacaggcaaaaattgttcaaaggcaacactgggagaaagcaagaacagattgcctctaatgaatcttctcacagcaagcaagctcccccaaaacaattaacagtgtcactagggattccccagtttccctccactgcttctccagggttggtttttagagctgggaactaagaacatatgctaatttatctcaacaaaaagcagatctctccattatattcctataatatttatgtatgaactatattcccccctatatagaaatgccaagcagttgaggttcattgactctgttatagaatctcccctctcctccagatgctagcccagtattaaataaatgcttttcaaataaacaaatagatgctaacaaataaaaatcaatgaagtgggaacacctaggtggcaaagttgggtaagcctcccgactcctggtttcccctcagctctgatcccaggatcgtgagatagagcctcctattgggctctgtgctcaccaagggctttgctttgagactctctccctctccctctgccccccacccctcccactgctcatgcatgtgcacacatgctttcacactctctctcaaatgaaaaaatctttttaaaaaatcaatgaagtgaataccagtggttctagagagagacattccagcactggaaacaagtactgaaaataagtacatgctcaacaaattgctgagtaaagtgctctttgaatatgacataaattcagttcctctaaattgtctaaaacactgactttgagataaacagttgtatccatcatgttgagcataatatgctctggagcataatattaagttgaggtaggtgttaggagatattattcattaaacacatatttaatgaatatgtgtttcattaaacacacataatgttttttcattcacacattatggaacacccactatgtcctggggacacagagaagaacaggacactgccccttaatcataggactctgctgtccaatacggtcaccacctgccatatgtggccattgatcacttgtaatgtagccagtcctgagatatactataaatagaaaaccactgtatttcgaaggctttgtaaaaaatatatgcattatatgtatttaaaattatatatctgaatatatataatctcattaatagtttttatattgattgttggttaatttgcaatattttggatatgctgagtttttgatatattattaatttcactgtttcttattacctttttaaagtgactagaaaacttgacatcgaatgtgtaactctcattgtattcctattggacagtgctgctctggttactcttggttggctaccaattaactattcaatgcttttcttagattcttcaatttagctgtaagcttttcaggggttggaggtggggggatcctttcctgtgatcacctagagattccaccagagggcgacttatcttccaccgtttcaattctggatcttcaatctattttatgtatatgtattgaactacttttagtttattatgcttcaggcactgtactaggctctagaaccacaattatggttcctgccatcccagatcttacaatttatcaagaaggctataaacaactaattatcatgtgaaaagaaagaagaatcaaatccattatattaatgtgccatatgaatgttcatatggtcttcaactttttgggatgaccctttcttagtaattaattaaatagttccaacagataatttcaggaattcaagtggtctagttctctcttcagaattccctggacagggcagcccaggtggttcagtggtttagcactgccttcagcccatggcctgatcctggagacctgggatcaagtcccatgttgggttccctgcatggagcctgcttctccctctgcttgtgtctctgcctctctctctctctctctctctctctctctctctctctctctttctctctctctcataaataaattttaaaaaaatttttttaaaagaattccctggacagagaagtgatacaagtgcatgtttccacatgccagatgcttaatgtctttttctccaacctcctgctcctggcacactgtttcagtcattttcaggctgctctctatcatagcaagtggctttctgaccatattttcaggctttgaacttctgtcgtgttgctggaagctgcttgcttcccttagaactttcccctcccatttcctgactctctaaatcccagacctcttatctcctgggaacaaactggaaattttaagcaaaaatcactctttgttctcgctttggcagcacatatactaaaatcactcttcctttatatctgtaagtagcttgatatataaaaatcaaaactcatatgtgaaaaacagtaactttttaaatatatatatatatatatatatatatgaataactgactgatctcattatactctggagcaacaaatccaaatgatggtaggaaaacccccaaactggacttttaaaggtacagatgcagctcttcctatttaaatgagatttttttttaatttttttttattttttattttttttatttatgatagtcacagagagagaaagagaggcagagacacaggcagagagagaagcaggctccatgcaccgggagcccgacgtgggaatcgatcccgggtctccaggatcgcgccctgggccaaaggcaggcgccaaaccgctgcgccacccagggatccctaaatgagattgtttttgaaaagattcgtctctcccctgggaaaggctgtctttcagggtttttcctctttccccttctccttccctcttatttgaatgatatcctgggacagaaggtaaatttatataacattatgactatgggaagctgtgtcttttttctcttctctgatggttctctacttccagcagcatcttaatcattggcctctgccctctctccttcaattaccaaagtttctgtggctggtcgaattggagatcagttctccttggcaaaggcaacagggctcagccactttccccactattggccccagtgcaagcctggctcttgctgcatatcccttacatcttgatgcacctgctacccgatcctgggcttgcataactgggactgctggcccttgaatccaggccaggtctacctgctccatgattaccttgaaaatcaatttactgaaaatcaactctctaaaaatcaagtcatgggtgggggtggggccggctggctcagttggtagagcttctaactcttgatctcccagttgtaagtttgagccccatgttgggtgtagagattacttaaaaataaaatctttaaaaaattgttttaattaaaaataaaaatcaactcaccaaatggccaactaagctgaaattaattcatcaaatcacaatcttcctattttaccgatttaccaaaaacttgattctttaactttatgaagtttttgttactttatacattgagttgaatggttttatgcattcaatttttttaattttagttgattagctttccttttttcttcatattagcttttaaagtaatgttcagggatccctgggtggcgcagcggtttggcgcccgcctttggcccagggcgcgatcctggagacccgggatcgaatcccacatcaggctcccggtgcatggagcctgcttctccctctgcctatgtctctgcctctctctctctctctctgtgactatcataaaaaaaaaaaaaaaaagtcttaataaaaaaaataaataaataaaataaagtaatgttcagtttgccaaatgttacaaatacaggaggatgataatggctgtagagttttttcattgccccaagtgtcctcatgaaaacagatcaattgggatagcaaaggaaagtacccagagacaatgtctttaacaaacgagggacaaggcagtacctggaactctagaatatgaatgggtaggtccaaacaaccacacaggatcctataggttctagctccgtgtggaggtagcaaaaggatgaaaaaggagagttttgatgtttataagatctcagaaacacagaaccagccaatgaatattcacctccaaaagaaaatagtcccagcctaaaatgcacactcagtaagaaactctaaaaaccaagccaagcctgaaattctaaagccaaaaatttcagaaacttctttttctgttactaatgtctgactttcaagactatgaccttgctgtgtctatcaatattctgtttggaattctctttgaagttatatgataaaaatccaaatgttccccaatacaatgagtatctctgaatgaataaaatcacatccaaagatgtgtgaaaaagaaaatagtaagacctttagtaaataatatttttataataaaatattatccctatatgtttcacagagacatgtgacttccacctgcctctactaatttagagtatttctttcataatgaaaaagcacattaatatgttttcctaaatcaaaggtcaattttctccttgagatcagttatatctctagaacacgaaagcagcttccagcactatgtatttaaaatagtaatcttttaaagttttagctcctacctttaaatctttgattaatttttttaaagattttatttatttatttgagagaagagagagagtgtgagcacgatgtgggaaggggcagagagagagggagaagcagacgccctgcagggtctcgatcccaggaccctgggatcatgacctgagctgaaggaagatgcctaaccaaatgagccatccaggcacgcctctttgatcattttgacataattttgtacgtgataagggtccaacatcattcttttgcatgtggatatacagttttcccagcactttttgttgaagtctgtactttctaccattgaatgatcttgctgctcttgttgaaaatcattgactatataggcaggagtatattggggggggggtctctattttattccattggtctatgtgtatgtctttatgccagttccacactgtttcgattcctgtaactttgtggtaagtttgtggtaaatgaggaagtatgacacctccaactcttctcctctttttcaagattgtttttggcattttggggccccttttgaattttagatggataattgtatttatgcaaaaatatcattaggattttgataaggattgtactgagtatgtatattgctctggataatattgacattttaaaaaatattatatttatttattaatgagacacacacacacacacacacacacacacacacacacacaaagaggcagagacacaggcagagggagaagcaggctccatgcagggagcccgatgcgggactcaatcctgggtctccaggatcagaccctgggccaaaggcggcgccaaatcactgagccacccaggctgccctaatattgacattttaataacattaagtcttccaatccatgaacatggaatgtctttccatttatttacatcttatcttctttcagcaatgttttttacctttcccccttctcatagaacaatcatacataggattactttattcctacatcttctcaattgttttttccccatatttgcccttttcctttcctacttggcaagatttggctttactcaaggatctttttgtgatctttgtccagtttcattctagtgataactaccttgctatgatgaatgcctacatggacagttgttcatttgccttctctttctgtactcattcaatgtagatgacatattccttcctgtaaacctagactacttcaccaatttgctgatctttctagtgtcctcacacaacatgtacttcatcatcctttcggatggcatttgttcaaacattatacttctgtctcagctctttggaaaaaggggacgagggatccctgggtggcgcagtggtttggcgcctgcctttggcccagggcgcgatcctggagacccgggatcgaatcccacgtcgggctcccggtgcatggagcctgcttctccctctgcctgtgtctctgcctctttctctctgtgtgactatcataaataaataaataaatttaaaaaaaaaaaggaaaaaggggacgacataatcttcctgtgaatgtgggaaggtgcattgaaatgcattttatagttcttgctctggtcaaaagtcacaaagattgaacttcattttggaggctggcacttcaacgatggctgcaaaagtctcatcagtgttttttagtcgtcagtgcatatagtattcacctccttgtttaggttaattcttaagaattttagtctttttaatggtattataaatagaattggtttcttttttggattgttcatcgttagtgtatataaacacaattgatttttttattgaagtatagttgacatacagtattcatttcagctgtacaacatagtgattcaacatttatatacattattaaatgatcagcattaactctgtcaccacacacagttattacaatattattgactatattccctatgctgtagtttgcctccccatgacttttaaccagaagtttgtacctcttagttctcttccatttatttcacccatcccctcacccccttctcttctggcaaccaccagtttgttctctgtatttatgaatctgtttctattttgctcattcgttttgtttttagactccacatataaatgaaatcatatgctatttgtctctctctgtctaaattatttcacttagcataataccctctaggtccatccacatagctgcaaatgataagacttcattcttttttatagctgagtaatattccattttatgtatatgccacattttatctattcatctattaatgaacttaggttgcttccatatcttggccattgtaaataatgctgcaataaacatagcgatgcatatatccttttgaattaatgttttcattttctggggtgaatacccagaagtggaattgctagatcatacagcatttgtttttatttttctgggaaacctccttactattttccatagtggatgcaccaattcacattcccgccaacagtgcacagggatcccttttcttcacagcttcatcaacacctgttatttcttatttttttgagactagctattctgacaggtgtgaggtgatagctcgttttggttttgatttgcattagaaacacaactgtggatttgtgtggattctgtaccttattactttgctgaatttctttttaaattattttttgtgtgtggaacctttaaggtgtggtacttattagatcatgcatctttgaacagagataattttactctttccaattaggatggcttccctccactcccagtttgtttaattgctctggctagaatttctagtgctattttgaatagtggctaaagcaagcatccttatcttgttccggaaattagaggaaaaactttctttcaccattgattatgctgttatctgtcagattttcatgtatggcctttattatgttggggttgttttccttctactcctagttttttgagtgtctcaccataaaagagtgtcaaaattttatcaaatgcttttttgcatcagttgaagtggatcatttcagtccacttaagtgtcattatattagtcataatgttagtgtcatatatgacattaattagtcatattaattttcatatgttgaaccatggttgcataccaagaataaatcctaattagtatgtattcttttaatatgctgctggattcagttttctcgtatttcaatgaggacttttgtatcgatattcataaaggatattagtctgtagttttcttttctggcagtgtctttgtctggctctggtatcaggacaaaaatagaatatcataaaataagttagaatgtgttctctccttttcagttctttgaatttgagaattggtattagttccttaacatttagtagaattcaccagtgaagccatcagctccagggcttttccttgtccacaggtttttattactgatttaaccttactacagttctactcagactttctatttcttattgattcaatctaggtaagttatgtgtttctaggtgtttgtcgattccatccaggttatccaattagttggttatccaattgttcctggtatcatcttttaatccttttttgtttctgtggattcagtagaaatgtccccggttcatttctaactagaaatttgagggatccctgggtggtgcagtggtttagcgcctgcctttggcccagggcacgatcctggagacccgggatcaaatcccacgtcgggctcccggtgcatggagcctgcttctccctctgcctatgtctctgcctctctctctctgactatcataaataaatttaaaaaaaattttttaaaagatttaaaaaattttttttgaatcttctctctttttttttcagtcagtctatataatggtttctcaatcatgtcactctctttgaagaagcaacttttgggtttatttccagtatatttttctcttctctatctctgctttaatctttattatttccttccatctgacagtttggggttgcttgttcttcttttgctagttcctaaaattgtgaagtaggtgattggtttgaggtctctcttcctttttaatgtgtttacagagattaatttgtcccttagcacaccctttactgccagtatgcagcattgtgtgttgtgccttagcttttgttcatctaagtatattctaatttcccttgtgatttcttctttgatctattgtttatttccacaaatttgtgaatgtttcagtttgccttctgttgtctctaaatgatattttaaattaatgcatcacatttttaagaatattctgctggtatttacgttaaatgcactatctggaggttgtggtatttttcattgatcagtcaaggtacgttccacgccttttgaggccaagtctatctatggcaatgcttgaaaggtgaaaagacatgttaactttcaagctaagattttcttacaccagggtttaagaaagctttgtgaagtttattcctccatttccagcacgcaacactacaaacctgaggtatatttaagatgtaatactggcaagaaaagagagagaacctaactgtggaaaagagaaagaaatgagggaaggtttcctggaggagtgacatatgagccaagactgtccaatagcaggaaaggagtcagaacagcatactctccatttccccaatgttttctgtctccgcaatgcctccacctgaggccttccccactagtgagtttctgcccctccctggaccccacaagaaatatcgcctccacagaagccttcatgttcccctcctcctccagctgccagcagaattgattgctttctccaccctctctagagatcactgaattaccccttagcattgagtcacgttttatatacttatgtatatctatgcgtgtttactttttttcttttccctgtgaagggcctattgtttaatgttcagaaatcatttggttgaatcctctcctctcataggtgagaacacagaaaggttctgtgcctaactcactattacaaaagatagtttttaaaaatccaaccctgaggtgaactgttttgaggagaatagctagaaccatgcatattaaatatattgtcaaaggttcaaaataagggcacctggatgactcaaccggttgaggtccgcttttggctcagattaggatctaaccaccacccccttcaagagctcccacctcagacgggtctctgcttctccctcttcctctggccctctgctctgttttctctctctctcaaatgaataaactcttcttttttttaaagttcaaaatagccaagtcaaaagcaatgaatcactattttgtaaaaacttattgtacacataccaaaaatagtttgcaaaccgggagctgtcaaaccagagcacagaatgagacttaggggtatattgttataaaatagcttatgccgtgagaaagcagtgactgtttttcacagattggctacaatataattttcagtggtttcttcatatcaaccatgggaaacagtccaatgttgcttatttccagaagagcaagcaagaaatgatcttggccaagacagccttgcaaatgcaaaataagctaaattaagctttgtttgcatgatcaaaccggctagtttgcttagaattttctttttttttttttctatttttatttatttatgatagtcacacaaagagagagagaaagagaggcagagacataggcggagggagaagcaggctccatgcaccgggagccctgcgtgggattcgatcccgggtctccaggatcgcgccctgggccaaaggcaggcgccaaaccgctgcgccacccagggatccctgcttagaattttcaaagctggtctccttcggtgttgattgtaacagacccaatctctcagtcaatgcaagacacccccaaaagttccacgaatacaaagcagcgctacctgggcggcactaggaccccaggggcacccgccggcgggtggtggcgcccgttagacgttcggcgagagcggggagccaggggcgggcgaggcggtaggagaggccgacggaggcggccgtcccgatccgccccccgggccgcgaggaggtgctcaggtgtgcggggaatggggtccggcaatcccggcgcggccgccgccccgcggcgcacgttccggtcgcggcgacgctgagggccccggccgtctcccggggcgcggcgcgcggtggacaggcctgtcgtaaccgcgagaggagagcgcgcgcttccgcggggacagcagcctgtcagagccggggcggcggcggggcctgggacccggcggagcgagtccccgcgcggacgcgaacggaggggcggggcttgggggcggggcgagcgagggcaagaccggaaggggcgggaccgagagaccgcgcagtcggggctggcccctgggggctgagaggtgctgacgggcccttcgggacggcgttgtgggaagaaacgccgtggggaaggcggatctgagatattcgaggggccccaggttactctaaagcatctggagccgacgagaaggcgctggtttccgggggggaatccggggagacgagagcgaaggagggaatcgcaggaacccggacagctgtgctgtttgacccagaacagcctgccaaggaaaccagaaggtgaagagcaggtactaggagaagcgccccgagacgtgttccagaggctgaggttgagagggtgacctaagccagcggtggcaatgacttaacaagatgaaggaaaggcgggttgaactgtgtgttcggaaatcggggaggcttggggaggctggctggctgcaggatggggagcaggagagtaccaaggggggccgagaagtaagggcggtgaggaggagtgtgaagcctaagccccttgggggctgggatggcattttaccttgatttcccgtcgctggtacagagtagtgtttgagctaaatggcattttcttgaaggtgattagcttccggatagcagtgctggatgccagcctgaggagtgtggatttatcttctaggccaatgagtcccaactcctgctcaccggaatctcctagaaaccttgcctgaagcacagattccccaaatcactgcccagagattcagattcagtgggtggcgaggtctggaaatctgttttcttaatgagttcccaactgattcccatgtagccaggtaacacctggcagatcctgaagatttctttttttcagttttattgaggtgtaattgacaaataggaattataaatatattaattatatatgtttaaggtgttcaacttgatgttttgatatatgtctacatcgtggaatgattacacaatcgagctaattaacatacccatcatctcagacagtagccagtgtctgtctctctgtgtgtgtgtgtgtgtgtgtgtgtgtgtgtgtgttgacaacactcgaggtctaccctgaacacatttcaactatgcagtacagtattgttaaccatatcaccacgctctacggtaagatctccagaacttaatcatcttggataattgaaaatttctaccttttgaccagttgctccccatttccacctccctctaaccccgagttaccaccattctgctctctgcttctaggagtttaactatcttagattccacatgtgagtaagatcatgcagtatttgcctttctgtgtctgccttcttttacttagcataatgttagctatatagctcgttagcatatgtattatgtataataacataatattttaatatacaatatatattcataggtatatacaatggatatatacttagaagtgggattgctggatcatatggtagttctatttttaattttttgagaactctccacagtgttttccataatggttgtaccaatttacattccctctaccagtgtacaaggattgcctcttctccacatccttagcaacacttaccttttgtattttgataatagccattctaacacatgtgagatgctgtctcgctttgtatgtcgagcttttcccatttttcttctaaattttatggtttcaagtcttacatttaagtctttaatccattttgagttgatttttgtatatgtacgagacaagggtctagtttcattcttctgcatacagatatccaattttccgaacaatattgaagagactctcccttccccattgggcatttttgaaactcttgttgaagactaattcaccatcgatgcactgatttatttctttgccctctattctgttccattcacctatatgtctgtttttataccagtagcatactgttttgataactttgtggtgcattttgaagttaggtggggcctctctcccatggggctaagaggtcccttttctccttagccagggatggaggccaagatcagcctttgaggatcattgtcagggctgccacaagctggcagccttgttttcctgcctcagacatctgtagttgctgggagcccctgcttgatccatatcaagcatgctagccccacagccagactagggtctgaactggcagcatggagcctctggctctccttacatagtgccaggctctcatgagctgatcctggcctgtgttgccccaaaagtaacttggcccctgcctactctataggcaacacctaacacacctaaacaggtagtcgtctacctcaaagatgcctttgaaggagtggggcctctcacctcctgctttcctactaaacaacttctttggccctaggggattcactgggagaagagagggttccaaaagtgggggacttctgttgtaaaagaggcttctgaggccacctcgctcagggagggtcaccattttcccctgtgtggattagcttgggtgttaccagaccactctatccacccactcagagttgtgtctcctgcagagagtcccatacagcattgtgaggcatgggatggtgaggaagagtcatgagtgggtgctggagaaggagcaccacagacatcaggacaaagaatcagacctgacactcactacatcagccgcaagtgcaagtcccgtttgtaagcagtttattgtatccaattggacagtttgggctccccacacttgccatgtgaagttttctgtgttgaagtactttcatcagctgacaaaataacgttttagaaaagttttaaagttctaacagtttttcttcactaataaaaattctgaaagcaggatgcctgggtggctcagtggttgagcatctgccttcggctggggtcgtgatcccggggccctgggatcgagtcccacatcaggctccccgcctggagcctgtttattcctctgcctgtgtctctgcctctctctctgtgtctctcatgaataaataaataatttttttttaattctgaaagcatcaaaaaaaaaaaattctgaaaacatctttttttttttgtcctaaaagcaataatccactttctgtgggaaaaaaaaaaataggaagattgttttggctatttgggatgttctgtgcctcatgtaattaagattattttttttattatctgtaaagaataccattgggattttgatatgaattgcactgaatctgtaaatcaccttgggtggtctggacattttaacagtattctcccaatccatgaacattgaagtcttttcatttatctgtatctgctttggtttccttcatcaatgttttacaattttcagtggccaagtttttcatttctttgattaagtttattactaagtattttagtctttttgttgctatgtgattaagattgtttccttaattttcttttcagataattcattgttagtgtacagaaacatcactggttttcatatgttgattttgtttcctacaactttactggattcatttattagttctaatagttttgttgctgttgagtctttggaattttctaaatatatgatcatgtcatctgaaaacagagataaatttatatcttcctttctgttttgaatgcctttcatttctttttaattgccctggctaggatttccagtactatgttgagtagaagtggagagagtgggtatccttgccttatatcagatcttagaagaaaagctttcaagttttcgtcattgattatgatgttagctgtgggggcttttaatatatggtctttattgtgttgaggtaagttcctctacatctattttgcttatagtgtttatcccaaatggatgttgtcaaatgctttttctgtgtctgttcatctgtcatgagatgatgatgtttatctttcattctgttaatatggtgtgtcacattgatttgccattattgaaccatctttaatcccacagataaatcccacttggtcatggtgtataatccttttaatgtgctgttgaattggtttgctaatattctattgagtattttaacatctgtgttcatcagggatattggtctgtggttttcttttcttcgtgttgtctttgtctagctttggtattagggtggtggtgggctcataaatggtttggaagtgttccttcctttttttggaagagttttaggatgattgatactaattttctttgaatgtttgatagaattcacccatgaagccatctggtcctgggcttttcctttttgggaggtttttaattactccttcaattttcttatttgttattggtctgttcaggctttccatttcttctcaattcctcttgttatatgtttcttttttttttccaatttttatatgtttctaagagcttctccatttcttccaggttatccaatttgttagtatatcattgttcataaagttccctatggttgggacacctgggtggctcagcagttgagcatctatgcctttggctcaggtcgtgaacccatggttgtgggatcaagtcccacatcgggctccccacatggagcctgcttctccctctgcctctgtctctgcctctctctctctgtgtctctcataattaattaattaattaattggttaataaaattccctatggtcttgtttatttccgtggcatccatttaatgtctgctcttttgtttctgatttatttcagtcttctctcttttctgtcttgttaagggtttatcaatttttttattctatcctctattttatttatttttgctgtattatttctttctatcttctaacttgcagtttggttcgttctttttctagttccttaaggtgtaaagtttgattgtttatttgagaccttttttttttgctaaaaacttcccccttagtattacttttgctgcatcccataagttttagtgtgttgtgttctcttttttctttttctttttttttttttccactgaaaagttttatgccttttggatagaaatgggaatttatttgccaggaaggatgatcccatcacacttctactgcaaccagcacatggcatctctttgctgattctgtgtttggccccaatgcagcctgtcctgcgcttcttgtctgcagtgctgaaacctggcctacacagaagtccaggccatagataccaatgcttgggtcatatttaatccccagatcagtgtgctcctggatccccaaaccaaagtttccagtatcagagaggttattttttcttaactcatactctcgcacctttagacctttctccaagatttcttctgccttggacctaaggactgtgcagtggacagcaatcttttcatttctcccaataccagggaatcgcactatgtatctagctttggagaacacagagttgacctgtgagctactccagcaccttggctgcctgggtcagtctctctccactctcccccacacagatgttgagtcagaacttgcagatgtgaagttcccacatggggttctcctttctaccttaatcctgtgccatggtggagaacagcatatattgtgttttcattttccttttctgaagatatttttaaaaatcccttttgaccaatggttgttgaagagtgtggtctttagtttccacgtatttgcgaaatttcccattttctcattgcttttgggtttgtttcattccatcatgattgcaaaagatacttggtatgattttgatcttcttaactttgttaaaacgtgttttttgacccaacatgtgtttgatcctggagaatgttctatgtatgcttgagaagaatatgtattcttatgctgttggatagaaagtactatgtgtgtcttttaagtccatttattctatagtgttgtttaactccactgtttattgattttctgtctggaaattccactcagtattgaaagtgtgttgaagtctcctactattattgtattgccatcaagttctcctttcagacctgtcaatatttgttctttatacttaggtgctctgatgttgggtgcatttatattcacaattgttatatcttcctattgaattgacccttttatcttaatgtaatgaccttctttgtctctaaagacaggctttaattaaggtctattttgtgtgatataattatagctacccttactttcttttggttacatttagcttggagtatctttttttttttttttttcattccttcatttcagcttctatgtatctttaaacctaaaggaagtttcttataaactgcatgtagtcggatcttgggtttttttaatccacttagtcactctttgtcttttgattggggggttaaaccatttacttttacagtaattattgattgagaaggattgttaccattttgttcattgctttctgtttgtcccaattttagtatatgtgctgctgcagcaagcacactttctgtttgtcttatagttctttgtccctctttttctctaccttcctttgcgtttatcttttttttgtattgataggctttagttatttcctttttcttttgtgtagcttctatacgtattttctttgtagttatcatggggcttattctagttataacactctgttttaagctgataacaacttaatatcacttgcatacaagaactctacacttttacctctcccgcccccacattatatgttattgatatcacagtttatatgtatttatattgtgtatccattaatatgattttggttatagttattttaatgcttttgtgttttaacttttacaccagaattaaaaatgattttctcgggcagccctggtggcgcagcagtttagcaccgcctgcaacccaggatgtgatcctggagacccgggatcaagtcccacgtcagactccctgcatggagcctgcttctctctctgcctgtgtctctgcctctctctctgtctctctctctctctctgtgtctctcatgaataaataaataaataaataaataaataaataaataaataaaatcttaaaaaatatattttcccatcactgttacagtgatatagcattccatatttgtctatattttcacctttaccaatatgtttcatactttcttaaattatcatttttctatagcattctttcatttcacttccctctaacattttttataaggcaggtcttagtggtgatgaacttcctcagcatttgtttgtctgaaaaagtctttatcttcccttctttttcgaaggacagttttgctggataaagcattcttagttggcagggtttttttctttcagcactttaaatatatcatcatcccactctttttggcctgccatgtttctgctgaaaaatctaatggtagttttattggtgtttctcagtatgtgacaagttgtccttttcctgctgctttcaaaattctctttgtctttgactttgataatttaatgtgcctcagtgtgggtttctttgggttcatcttctttaatattctttaggcatcttggatctggatgcctgtttccttcctcagttttgggaagtttccaatattatttctttgaataagcattctgcccctttgtctatcttcctcctctaagactcccataatgtgtatattgggccatttgatgatgtctcgaatcccttaagctatctttattcattcttttttcttttggcttctctggatgatttccagtaacttgttttcttttttctttctttttttttttctgtgacttgttttcagtttcactgatcctttcttctacttgctctagtctgctgttgaacacctctgttgaatttttcagttcagttattgggttttcaactctatgatttctgtttgatactttaaaatttttctctttgttgaaattttcactttcttcatgctttgctctcctaacctcagtgagcatcttaatgactattattctgaattctctgtggagtgaatcacatatctccatttcattaggattgatttcaagatatttatattgttcatttgtttggaatatatttccttgtttcttcattttctttgactctgttgatgcctgtgctttagaaaaaatagccacctctcctagtcttcatagactggcttcatacaagagatgacccttgccagtcatcccaaccaaagattaggagggtctttcaaatatttttttaaaagattttatttatttattcatgagagacacagagagagagaggcaggacacaggcagagggagaaacaggctccacacagggagcccgacataggacttgatcctgggtctccaggatcatgccctaggctgaaggtggcactaaaccgctgagccaccggggctgcccgggtctttcaaatcttaatgtgtgtttccaaaccactgtctgtgttcttagcagccaccaggaatctagagtgtgacaagtcctattagtgctccaagacaggtgaggtagaagccaattccctgagtagtagctggaaaagttgggtgcttcatgagtgatccaaggaacattctttcctcagggatattctgggagttagaatttatcactcattctgcactaggccaagaagaagagctgtgacaaatgtctgtattcttgttcagaccacatacttttaaaccattgctttgctctctgtagcccccagtggcctaatgaatgttaagccctgtcagctctcagagactggtgagttggaagcgagtctttccagtagcatctggaaaagttgcaaggctagatatatattccaactccttccaggaagaagctggaggcttgattttacttctggaacaagccagggggaagagctgcagaaagagcccacatcctcattcaagctttcgggagactagtgattacctgccttatcagctcccagaaacaagtaagttagaggctagacctttgggcattagtaagaaaagtcaggatgctagatgtgcagtctaattccttccagggagatgttggacgctgcgctttatcactcaagtgaaccagggaagaaggagccataggaggagcccatagacctattcaaaaccaccacttgttctctgtagtcccgaggagactagaccatctgtatctactagcctaattacatcatttatattttaaacagctagaaatcaactctataatgaaaatgtctaagaaacaataatctcatgtgccattagcttttctctttacaattttttttaaagattttatttattgatttcatgagagacacagagaaaggcagagacataggcagagggagaaacaggctccctgcagggaacctaatgcgggactctatcctagaaccccaggattataacctgagccaaaggcagatgctcaaccactgagccacccaggtgccctctctttacaattcttagtcaagcctaaagtgaacatctcccctttgaagaatggacctctatagcacctgagccttcttgtctaccatgtgacagatttctatccaggctacattcaaccccactggttcctgaatggacagcaggaaaacagctagagttatgtccaccaacctgatcctaataaagactggatcttccagatcctggtgatactggcaatgacccttcaccagagagatggctacacttgccaagtagagcaccccagcctggatggtcctgtcactgtggagtggagtgagttactctctgagttaggccctaaattctgaaaaacagggaatattctagttctgggatctactcattttgtcacaggtctatacgtgggggccatacctatctccatctttttcctagagaagtccctgagaatagtttagagctggggcagcagagacttgcccaccctgtcctaggaaatactaatgattcatagatctctgcccatgtcagaaaacctaggaaactcaaacaccttcctgaattatcctcacatgtgagaactgttaaatgccttcagccttttagcttatgtgagttattttgagaggcagctaccagaatcggcatgtgtgtgtccttttggaagtcacagcctaattttcagaacttgggggttctttctaaatttcctcctccttcaagttttatatctctcacagacctcatattggtattctatattaagccccagaatctcagacagtacgtgaggggtggtgcagcaggtagaggtgaaaatgacccctggtctgtgtttccctgagatacacagattctgctcagagaaatactggctagactctcaggctttgtgctggggctcatcttccttgtagtgagcatctgagtgcatactaggagcaagagaggtaagaaaacctgagagatggctgaggtttgctttcccctgacttactcaaccatcttcaattaaaaaactgatacagaaaaacaataccagagaatcctggagttcactgaaatcagattgttgggaagcaaaaatggcttgtaggaagagagaaatcccaggccagaattttatcccaaccagatgtatggagtctccaaatactctggtcatgtctgagttcatttagtaatgaattagtcttcagccagcccctgccttacttcccagtgattggaccatggcaatggagatgagatgggaaagtttatctaattgtctaagattctgttattaggtgaatacattcccttttctcctttcattattctgtgatgaggatcttgaaaaccaggtaatactcctgcttctttttcttgggagtgggttgcagaaagtcctttcattgcatcctgactctgagacgcctactgggaagaagcatacaagtgtggaaatgagcattactttgctccattgatgaaggaagcccagagaaactcttatttttcatcaggctaagactcaatctctcacgaaatttctctttcctgagatttagagtaagaaatgtcaacaacctgagacaacttttccttttacctccgctagggttcctgatctgacccaaagacctgcatgtgacctggaacaagcatttttctatctttcctcagtcccagaggctggttccggaaaagacttcagcctcccaagaacatgttactgccaagtaattgctctgaaactagtttctatagttgttctctttgattccatgcacactttctctcggggcttctatccaagttcctttagggtagttccatgagtaataaaaagccaatgttaaagcatattctcttaagaatatgcaccaagtcatctctgccactgcctttgtgtgaggattttggcaaacagtaggagttcatgaagaagttcattgttgtgtatacacaggcaagaaggaaaatgtgaaaaggggatattctaactattgggaagggtgacaaattggacatggacctcctctgaattcatactctatctttgggctgccccatatttgtatttgatactttcattcctggaggcctgggaccattcttagttattcaaggatgagcagatggtgaatacagcactgactcaacatacatgaagactgttttaccattaccattaagaaatcaaattaaggggtgcctgggtggctgagttggttgagcatctgactcttgatttcctctcaggtcatgctctgagggtcccagaatgaagccccgtatcaggttctacactcagcagggggcagggaggtttggcttctctgcgtctctctatctctctctcctgcccctcccccctctaaaataaataaataaatctttttaaaaaatcaaattaagatcagaatttaaaattggaaatataatgtaataaacctaaacccttttctttgataccatgatagtctttgaccaaacaaggcttagccttttttttttttaatattttatttatttattcatgaaagacaggcagagacataggcagagggagaagcagtctccctgcaggaagcctgatgtgggactcgattccaggatcccaggaatggctcacaacctgagccacccaggcagatgctcaaccactgagccacccaggcgctcacaggcttagcctttttaatgcaacaatttatagaagatgcgtcatcagaccaccaggcttcctgtcgtagtaattcacatagtgttaaaatgctcaaagaaatagatgcagttctcttttttaaacatacgtctgcttttacaatccaaaatgattacaggttttctgttttacgtgaaattatcctgaaagccgagctagattctaagtagttctttttgcataaagcatggagtatgacctcctgaggcacatactggggactcagaagatctctgacatacccaggtgatgcctcctctctccctgcctcctcacaagcagctcttgcctcttgtttgcccctgggcccccctgctccatcagttcccactgcttgctcctctcacactgctcccctcccatcatgccctgcatgggaccagcttcccccatttccaagagaggttgaggctgaagatgcagaagtgggtgttactgacacaggagttagcatagttggggtctgtagaaaggttggggtgattaagtgtgggagcccaggaagaaaggccctgagcatggcaaaccaaccataactcccataactcattatgtatgtgcattgctttgtttaattctaattactcagggataaggacatggttttttctttacttatctgttccaggtgcatctgcagtggccactgtgagccagacagtgaggagaaaatgaggcagagcagggcagggaggagctctgaatccaggattcatttccctatctggtgaagggagaagaggtggaagtgaaaccgctcaacagggctcacccaaccagaaaacatcagaaggggcatctcagtgtctgggaaacaagctagaaccaacatagctgagaaagccccaacctatatggggttcaggggtaagaggaagaaaataaaaatggagacatgataatcaccttcctttcaatggagttgataggaaatacatctttgaaattgatcaaattaaaaagatttttaatttgtaagtaacttgtgaatggataattttcttcatgatttcatgttgattttttgtatcaatataataatccacttgattgttattaaataatgttatattttacccttttgttcttttgataattttggaggaatctgatgtttccagacatataatcagaatgcaaaaaatattatttcacttctaaatattattcctttttatttctttttttctgctttaatctttttttaaagattttatttatttatttctgagaatacacagagaggagagagagaagcagagacacaggcagagggagaagcaggcgccatgcaaggagcctgacatgagactcaatcccgggtgtccagaatcaggccctgggccgaaggcggcgctaaaccacttgagtcacccgggctgccctttttttctgttttatttcttcttgaaatttttatcttctttatacgagatgtctctaatattttactacttagtataaaattaattctttgctttataaatttttaaaaaataaatatgtcttttttataaatttgtgtagaactgtagtaaaagcccctgatacttcttaacaaaatgatagaacttaattgttaaaattaattgtatgttgtatttattcaactgtttttgttttgaattaaacttgcaatataataatgaacatttcttgattccttactatgtgcaagactctgttttaagagctatacaaatactgagtattatcccaattagatttcccaataaaccaatgacattcactccatagtaatctccattctacatgagaggaaactagtcacagtgggttaaaaaaaaaaatcaggaacacatatcaggaatcacctgtaaattagttctcacaatatattgtgagaactatatttgatgtttaaaaattccaccccctccaaaaaaatattaaaatgcaaagaaagtatggaccccaaaggttaaaggtagggagtctgatccccctagattttcaacaccctgcttagaacttgctctgtcccagaacatgtccatgcaaggggggtggcgttctccatggaaagggaatgacattccttaggatctgctcctagggcagccccagtggcgcagcggtttggcgccgcctgcagcccagggtgtgatcctggagacccgggatcgagtcccacatcgggcttcctgcatggagcctgcttctccctctgcctgtgtctttgcctctctctcgctctctctgaatgaataaataagtaaattaaaaaaaaaaaaaaaaagagttcaggatctgctcctacggaggaaaatatataaacaatcaagacttttggctcacccagttgctcaaaatgaggatccctttcatcatactgttttcggtgaatcttaacaccttaaagaatcatgtgctttataccaaatttctgtctggtgacaattcctactaattggttcctttctcagaatgtggccacacccagaggatatgggaggctgtccaggctcattgtctctaatattttaatattatagtatatagtatataaattaatatattaatatattttaggagtggggcccattgagtgagagcctttcccaggctccaagatagtggtcctgaggatcactggggtcccaggaatggcagctctcatgatgtccttagtgatgctgagctcccctttgattcagagcagagacatgccaggtaagtgcagagctgctgcgcttagaggatccagttcagggtaatgagcttagggagctttccatgtgggaaaagagaaagtctgagaaagactttggggccctgacatcgtgcaagggctactattctcaccagaaagagaagaagatcagggtgtgcctgtgatggagacaatggtacctggtggtctggagtgattttggagggacaaggttctcacaaaggggtcatcaaaatgacatttcaacacccatcagaaatcagaaaggggaaattatggttagcctgccttgtccaagaactgaagatgactctgtagaatcagtgctccaggtaggggccccttgcacagaaccaggcaggaaccctactggaaccagtgaggaaccagtgatggccagagcagcagaagggagtgataaagacaagctatggttaaagcccataggttacatactgaagctaaccatccccccaccttcccatgtctggaacttccacatccagcacagtaggatagggccagagaggaagcaagaaacaggatgtggcattctccttaagctgccccttatgcataatttaatattataacttctggttttctgtattaaatcctcatagcacctcttaatttctagtttcaattcaccaccaagaccatacataatagaatggtgagcagtttatgttaaaattctccatctggaacatatttatccatagccccatactttgctccagggccaggaaccctgtgggagacatgaccttaattgacaattggaattcagatatccgtaaactggctaacatcctgggatctgcaaagatggttacagatgcccctgaaaaaatatggggggaataaagtaaagcctggcaggatagggcaggtgtatcagaagactagtgggtagagtacaatacaatgtggtataaaagaagacagtaagtcagtaaaggcttatcatcactatgggaaactcctgcaaaaccgtgtgtctactggaagatggatcttttctgctgcctggaagaggagaggagcccttgggtcagagtccaaaagtggccagggttctgggtgaaataaaaggggagtgaacaaaggaggctagcaacaggatggagaagatgatatgaatcgtttagagtaaatcaaccccacagtacaccatctttatgccttataccccatgctataggttagggaagtaccctaacttggggtacttggggagcagagcaaacattatccagacctggcaggctcagatactgcagtaactatatccacattacaggtccaggatatgtgctcctagggaattgaagatagagaaaaggccctggagtcacaaagaaggcaccagagatgtctagcacacacggtatttattggtccttgggattactcagaaaggatactctgtagagaggagtcacagaagaaaccagggcctatagaccatccagtgtgggggccaaattgtcaccatacatcaaatttcaacatttattaagtacttcctatgtatcaggccctttgcaggtgctaagtactagtaggatcacagacaggaaggaattggagaggtctttggagacatcaatcattggtgttgaggagcacagagattcaaaggcactggacctttaaaatagatctgatgctggggattcccctatgtcctcttctgtcacatatgggttgtcacctgcagtagaataaacacagtggggttgggactcttgggttagcattacatgctctagccctttacacctgcctcttttttctttttttttttttaatttttatgatagtcacagagagagagagagagaggcagagacacgggcagagggagaagcaggctccatgcaccgggagcccgacgtgggattcgatcccgggtctacaggatcgcgccctgggccaaaggcaggcgccaaaccgctgcgccacccagggatccccctgcatttttttttttttttttttatgatagtcacagagagagagagaaaggcagagacacaggcagagggagaagcaggctccatgcgccgggagcccgatgtgggattcgatcctgggtctccaggatcgcgccctaggccaaaggcaggcgccaaaccgctgcgccacctagggatccccatttttttttaagtagactctgtgctgggcatggagccagtgtaggcttgaactcataaccctgagatcaagatctgagctgagatcaagagtcagacactcaaccaactgagccatccaggaaccctcttgcattttatataataaaaataagataggaggtactgatgcacaaatcgtgtgatgtctagctttcactcatgttgcatgtccagtgtgtcagcaagatagcgctgctaattatagttactcagggagcaaggctgacagatctttgacacctgttcccataatttcccaagcagagtgaaggaccctactgaatcatacaatggctcttaatgatccctcttggaaataatgaatcacttctcacatttcattatacaaagcaaatcacatggataatttcaaaagagttggaatctttggaggtagaaagtattccataagtagacattaaataaatgatatattactcacttgagaacctactatgtgtaaggaagtatgctaggtcttgtgggtaaaaggagcttctagctcctaaaaggtttacaaattatccctaaagaggacctctggggtgttggcaatgttcttttccttgacctaggtactagttacatgggtgttcacttgacaatcattggctgtacattaatgttttgtgtatttcttacatatgtctgctagttcacagtaaaatggtttaaaaggagaggcaaagaaggatattggtaatttgaggcaaaaacaagaaatcaatgaatcaagtagaaataatgagctttaataatggttggaataaagaatatttagatgaaactagtgggactcctgcaactgaagaataattaataaacaagagctcagactgagaaatactctcaagggcagtatacgaaagattaaacaatgaaagattaaacaaaaaaaatgataaaaaagaaaaatgataagatataaaggatcaaaactgacatcctggcatcttgataattagatacctagaaagtggggaaaatagtaaaaggagatgaaatgtctgaaacaaagaatagattgctaggctttaaagaaagacggaatgactgtttgacatagtgcattgatcaatttttaaaaaacatctctctttaaaaagcacacatgtctagatgcattataagaaaattgtaagaatgtcaaagacaaaaagaaaattctcaacacttgcagagagagcagttccacctataaaagaacaagagcagatccatctagaaaaaaacaatcaaactgacatcattcctatcaacagcagcacttaatgccaatgggatgttacttgcatagaattgaagaaaaagaactttcaatcccaaaatgtataccacaacaaatggtcattttaatacaacatgaatagtctcaaacatttcaaccttagattctttactattcaaaaaaccacttctaaaaaattttttgaaaagcaccccctaaaaaaacagagacacatctaagagagatgtggaataaaagaaagatcaaataattttttaagtttattattaaacttaatagaggctgaagcagaggctgaatttaaaaaatattaaaaagcagaggctgaatttttttaaataagaaaagtgtatttaaaacaaaccaaaactctggcagccccggtggctcagcggtttagcgccgccttcagcccagggcctgatcctggagatgcgggatcaagtcccacattgggttccctgcatggagcctgcttctccctctgcctctctctctctctctcatgaataaataaataaaatattttttaaaaatagctgtaaaacaaaccaaaactaaaaatgtagttagtattaacataatggaggtgctaggtagtgataataggagaaattaaagtattataaagttcttgtctctttttgcagggcaggataaatagagggatctatcagtgttttttaatcaaagtaattaagagcattaagctattttatgaggataattagaaaatacaactgttaaagtaacagaatttggcctagcctttaggaactgagagatgagaaaaatgaacaagaataaagtatattaaataaagcattttaatatgatagtacatttttaatctaataataattgcaatatatcaaatgagctaaacaattaattaaaaagcagtgactctcagattgtatcttccagtctaataaaatcagatagcataaatgaatatcaaaaggttgaaaaccaaataatggaaaaagagatttgaggcaggtaagcaaagataactgacataacaaatttcacatctgccaaaaaaaaaaaaaattaaaggcaagtgtaaaaactagagcaagaaactataatgaacacgaacatatatccccctgaaaataaaaccttaaaatacaagagcaacaaatgacagaaatatgcagagaaggactctaacaattgaaaatcttaaaattaaactgcagattttaacatatcctcaaaaactaagagcaggagcagccctggtggcccagtggtttagtgccgccttcagggatgtgatcctggagatgcggatcaagttccacgttgggctccctgcatggagcctgcttctccctctgcctatgtctctgcctctctctctctctgtgtcggtcatgaataaataaataaaatctttttaaaaaaaaaactaagagcagaagcaaaaagaaagatatagaagatctaaataatacaagaaaaggctcaaataactacagagatattcacaaccaacaatatgcacgtttttgagcacacatggcacatttataaaaataacatttattaagacacaaagaaggcctcagtgtgttcaaattaattatcacagatgttctttggccataatgcaactgaagtctaaattgggtgcacctgggtggctcagcggttcagcgtctgcttttggctcaggtcatgaccctggggtccgggatcgagtcccacatcaggctccctgcatggagcctgcttctccctctgcctgtgtctctgcctctctgtgtgtgtctttcatgaataaataaataaaatcttaaaaaaaaaaagagagagagaaagtcataagcatcaaagacaccagcttgggaagcaaagaacaccttcccaacagcccctgtcctaatgtggcacctaggacatttcaaatacaagtcgttcttctcttatacatgtcattttagaacacagagaggaacaaaagccttccaaatcatcttatgaggctggtgcatctttattttcagagccagctaaggatatagattaatgtcagtcatgtcactgaatccaacaatgtattacaagcatgattcatttcaatcaaataagattactaatactaggattgtgtgagagcctgaccattagcttattttattgtaatgtaagtgcctgacattaagcttttgattgccgaggtattcatttcaaagatatctatcaaaagatacatattgcctgatatacaactagataaacagtcaggctgcaccctgcccccatgcagttccccttttagaaagccttgggtgacctagataacagaccccttgagtgaccctgcttttcccttcctatgcttttaattccagctcttatgttttaaattcaccaataaagagtgacctcatgaattccgaggcacctcttcctcaaccccaataatggcagatcccgaggtctctcctgcccctcacaacttcactgtgtagctctgggcatgccctgtaccccccagggctgtgggtaataaattaataaatcttgtttatttcaaagttccctgatggttgttgctaaggaatgaactgcagtcataagaaccacaagggccagttgggccctaacattggctcctgtctgagaagtgtctgtgggagctcaccacaaataatagggacccaggtgagtacccccaggcattcctagctgattgcatcaccatcattaggctgggaccacaaaatacctaggcatgcagtgaagtttcaaggtaagaaaatcagtaatatgaccctaaaaatcagtaaaccaaaaaagaacattcatattaatttcaactgaattcaataattgtataaacaatttgatcaattttaccacatggtaaagattataaaccaaaaacctatagcaaatatatttatggagaaattaaatgcattccctttgcaaaaggtaggatatcttttataattataaatgtttaatattggaggttctagacatcactatgttgtcatagtttcttctgttgaagaaaaccaaggttatgaagattgtcagggagagataaaatggctgcatattagataagactgagcctctggagccccaatacctgagttcaaatccagactctgcctttcaagttgtgtggccttggacagattccttcactcttcttcatgtctgcttccccctctgtatcatggggaaagaatggtaccaacttccaaaaataagtaagtgaatacctaattttaggttttttccaaatgaatggcggaaaaataaaacggcagagccaggcagtaggtttgagagtgctttaatggggagcgctcccgggagaggttccgtgacttggagaggtggcccgagtcagggaagtcgcgccggggttggggagtgtgggggtttttaagcctcattggttctgggtctggatctgggtgggtcccttgccaaattaggcaagggaacaccgtgtccctaggtgattgactgggggtgggatagtacagacaatgggggggtggtccctggctggaaggtcctgggtggaaagtttcagtttctcatctaggcttcgatttactggagatgatgtggtggtcattaccgctttggcgggaagatcagccattttgacccaatttgagatgtctgccattttgagtgcccctgtctctcagccagtccaacacctaagaaatttatagaatggtgcctggtaaatagtaagcacctcaactgatgctcattatcattgtattgttttcctttagttcagtgattttgaaatgcaaagtgctcaagaacccgtgtcgaagttcttctctttctcatctaccacccataccatgctgtctcttcctttgcactgtgtccttagtaccagctctgggatgactcccgggggcctctggcaatgctttcaggcctcctggtcttcaggacaatggcgccagtgatgatacctgccatgcctgctaccagacccagggcacagaccacagtctccctctcttaggcacctggatcagctcctaggcctctggggcacaaaggaaagagttagaaggtgcagagggcaggaggtggcttcagatgtaggggtataaaggattaggaaccatgagatcaccagtgaggtttgaataaagtgacaataaaacacacgagattaaggaaagcagatgctgcagagagatggatcctggaaataaagatggttgtcaggacagcgtgggcaaagggcgggagttccataccccagtgctgaaggagtggctggtccaggccccagtgctccaccttgcagtcatagatgtcttcagggcagcccggatggctcagcaatttggcgctgcctttggcccagggcgtgatcctggagacccgggatcaagtcccacgtcgggctccctgcatggagcctgcttctccctctgcctgtgtctctgcctctctctctctgtgtgcctatgaataaataaataaaatcttaaaaaaaaaaaaaaaaagaaagaaagaaagaaagaaatgcttccacgggacgcctgggtggctcagtggttgagcgtttgccttgggctcgggtcgtgatcctggggtcctgggatcgaatcctgcattgggttcctcacggggagcctgcttctccctctgcctgtgtctctgcctctctctctctctctctctgtgtgtgtgtgtgtgtgtgtgtatgtgtgtgtgtgtctctcatgaataaataaaatcttaaaaaaaaaaaggaagcagaaaaggcttcctcagccccatattcattattatattctcctctatattcttatgttaacctcatagtttactcccctcagagctttactgtctaccagagacggagcacctgctacgagctcaacgagctcaacgggacgcaccacttgctacacacagagctcttcgcgcaattggacagcgcggcgggggtgttcgcggccgtgtccgagctgggccgagtaactgccaggaactggaacgtccccgggagttcctggcactgagacagagcgccgtggacacagcgtgcaagcacatcttcgacctggaccagggtttcacgctgcagcgcagaggtgacagggcgggtgtgaaggagacactctgggaggagagggcggggcttgggcagcagaggaggggagcgccccagcacccccctccccgcgccccagaggaagccaggaaacacttaggttaaaatgaagaacaaatcaagctatttcatttcttctctctctctctcttttttttaaagatttatttataaaaaataaaaataaaaaaaataaagatttatttatttattcatgtgagagagagagaggcagagacataggcagaggaagaagcaggctcttcccaggagccgtacgtgggactcgatcccagatcccgggatcatgacctgaaccaaaggcagccgcccaactgctgagccacccaggtgtccctatttcttctctttttttaaggagaggatcagactgctagatcaaaggaaatctataggctgaatatattcggatttcaagatagtatctctcaggattacacatccttttgacccagatgagaacatgtaaattcagggagctcccatagctggttcaagatttctgctcaaagaattttagttactgtcacttacatttctggcaaaaaatgttacagagcacagactctggccctcttctgttctttgctctttctttactggtcatttacaaggtcattcttagaacattggaatgtttcattccatttttcctactgtgttgcccatcttctcccgctaagtagcttcataggtgataggactcatctttaacatctgagaagtcaatgtgacaagaaaacagctaaatgcactgctctggccatctcagctgtcataacaagattctctttccctcctagtccagcctaaagtgaacgtctccccctccaagaagggacgcctgcagcatcacaacctgcttgcaggccacgtgtcagatttctctacaggccacattcaagtccgctggttcttttttttttttttttttttgtgatagtcacagagagagagagagaatgaggcagagacacaggcagagggagaagcaggctccatgcaccgggagcccgacgtgggattcgatcccgggtctccaggatcgcgccctgggccaaaggcaggcgccaaaccgctgcgccacccagggatcccatgtccgctggttcttgaatggacaggaggaaacagctgttttttttttttttaaagatttttatttatttatcatgacagacacagagagaaagagaggcagagacacaggcagagggagaagcaggctccatgcagggagcccgacgtgggatttgatcctgagtctctagcatcacgccctgggccgaaggcagcgctaaaccactgagccacccagggatcccaacagctggggttttatccaccaatttgatccataatggagactggaccttccagatcctggtgatgttggaaatgacccttcagcagggagacatctacacctgccaagtagagcaccccagcctggacggtcctgtcactgtggaatggagtgagttactccctgctggccctccagactccaggctctgaggtctgctcattttgtcttgtgtcactacactatactacaactacactaccccatgttgttcctcatccacccaacggtggtcttggctgggaacagtgaaggtctggcaattctcccgtacgtttatcctgctctgggggagtctaaagaatctctccttgtcaaataacaactcagaaaggcagtcaccttcatgactggccctcagacatgacaacacctctcccttcggtctcttaagtttggacttaataggctgatctaaaactcgcatttgcctcctgtagaagtcatcactctgaggcccagaactttagagtgccttctgcctctaccccttttccatagtgcctccaagcttggcctttcttttctctccgtggtagattagatcaggctccaggtgtcaaacagggccttgaggttgtggcaggtggaggtgagactcaccctgacttctgttccccaggggtacatcagattctgcctggagcaagatgctggctggagttggaggctttgtgctagggctcattgccctcttggtgagcttcattctccattttagaagccagtgaggtaagaaacttctggaaaggggttgatactgtctttccactgtctcactactcttcagtgatgaagttgtgacaaaaaggcaaaacaagagactgaaagaggcctctgaaatcagatgctgataagccaaaggcagccctggaggaaagaagatgcctagccaaggtctgatccaataagataccggaggctgccaaagttaccctatcctacagggtgttcttttcagcctggggtagactcacacctaaagtgtgacatggggactgtggtggaaatttttggataattttctaagatgctgttgctccttactctctagatgaccaaattcatcttccctcaggatgacagggacctcaaccaacagatggtatttctgctcccttcttccttcttgggatataattcatgtcattgcaacataagactgggagcattcaatgagtatgctatgttcaggatagatcatagaaagtgccctgagaatgaggagaaactcaaacactccacctttcttgcaagttgagccaaattgcccccaactcttgatgccattttcctctttaggtggatgtggccacagagcatgactttgctccattgctgaaggaaacttcagaaactctcttccattgctcagtaggccaacattcagcctacctctgtaatttttttctctcttttctcttttttctctagagggaaagaaaatgtagcctttgagcttcagatgttttaaattcttcttctgaggcacctgagtggctcagttggttaagcatctgccttcggctcaggtcatgatctcagggtcctgggatggagccccgtgtccctgggatcaagccctgggtagagctccctgctcagtggggagtctgcttctccctctgctccttcctctaccccccagtctccaccccccactggtgcttgctttcatactctttctttttctctctctccctcaaataaataaataaattctttaaaaataaatggaaataaataaattctcattcttcttcgtagggttcctgaactgatctcaaacatcacatgtagccttgaaacaagcagttctgctattcctgttatccagtaaagtcccacctccagaaaggagattatggctaaattgtgccccctgatatcagtttccgagtcgcagcattttcattcaatttacttctttctcaagttctcccaatctatagagtgaccttccctgaggaacataaactatctaaatccaatattattctcttttttttttttttgagaggagggagataaatatggtcatgtgaccatgtttatggttgaagggttcgatgatcattgttgtttcacgcaggcatggagaaataaccttcttgatgggttattgattgacccattctccttattgaatagaaggccaactgataatgaatctcctaaaatttgctctacttcattgtagatgattaaattcatgctgcattcttactagcgaggggtggaaccattactcctagaaatcccagatggaacagacactgagcctggattttgccattgacatttatataggactaataaagcatgtcaatcattaataatatgctttccaagtgtaaaagtcaacataagatcagaattgtaaataataggtttattagatcacccaaaacactttcccttctgagtcattcagtagaaagtacatctctagttccaaaaaggtcaaagatatgtgtataccagatttttcagacataggccagcttttagaatacagttcattatacttcttataaatctctttaattaatgttttagactaagacagaaatcatatttttttcagacatttcatggtatgatgtgccacctaagaccattactattactatataatagtcatcaggaaaactaattcttgtaatatttatagattagtatcatttttcaaaatgacagtgccttagccaagcttaaagagtttttctgggcagcccgggtggctcagcggtttagcgctgccttcagcccagggtgtggtcctggacacccaggatcgagtcccacatcaggctccctgcatggagcctgcttctccctctgcctgtgtctctgcctctctctctctctctgtgtctctcatgataaataaataaaatcttaaaaaaaaaaaaaaacaatgcttatgggacacctgggtggctcagcggttaagtgtctgccttcgactcagggcatgatcctggggtcccaggatcaagtccctcataggactccctgcgtggagcctgcttctccctctgcctctgtgtctctcatgaataaataaataaaatcttaaaaaaaaaagagtttttctttcttaactgaccttctacataaaatcaatttgattaaatattataaactatgactataagttagtttttggtgattttaaatacaagatagccaccttgtgatcaaatatggggctgtgtcaggggtctccatgaccacccagattaggttattcactaggaggaatcatatagttgtactcatggcttagatttattacagcaaaggtttacaaagcagagtcagtcaagggaaaaggtacatgtggcaaagcccagaaaaaccaggtgcaagcttccaaaagccctctccctttggagccagagggcacacttaattcctccagccatgagttgtgactacacaaatattgtctgccaggaaagctcagcacacggcactcaggatttttactggggcctggtcatgtaagcaccatctacctagcacatacaaaaattccagagtcacagaaggaaagcaggtgttcagcataaaccatatttttatacagtttaggtacaatttaggcacattcttattagatctgagaattcaagttcccagatgccaggcagaggccacctttgtactcaggccaaaaaaatagtagatggacctgctatgttacatctttcctgcacaggagcaagccatccattttgctgacaatttttaaaataacatgagtacccatttttaaaaaagattttatgtatttattcacgagagacacacacacagaggcagagacataggcagagggaaaagcaggttccctgcggggactccaatgcaagacccgattccatgacctcgagatcatgacctgagctgaaggcagatgctcaaccactgagccacccaggtgtccccatgagtattcatttttctcaaagaaagacatacattgatacagaatgcacccttgaagactagttttctggaaacatgggttgttgcggaagacatagagttaaattcatataatatttttcattattgttattatgtgaaattattattatattttatgaatcctattagcatttaagcgggtttttaagaagtaatccctatgcccaataggtgactcgaactcacaaccgcgagaccaagagctgctctcttcaatgtcagaaccaccctggtttccttggatttaacagtttttgaatagctgaagtacaagcaaaggatgcagatgaaggtaatctgttccttgaagtttttatcttttgttcaatgatatgagaaattacacgtgcttcctagcctgtgatatttctagtagaggacatgggtagcccacctctcagtgccccaaatgagaaagttaagctgtagttcatatgtctactctcaattgccttggaaaaatgagaaaggcaatccacttagtgcccaaagaatttcacatgcaagaagattgactatgaatgagcctgtcattgcctgcactgcctaaaataagagacatttcactacttcagattttgataagaacaaacaagtcttgtcaacagaggactgataaaccagcatttctaaagcataattgttaatttaatattatcttgagtcataattaaaagcgacttagttttaaaacatttgcctattatcttagagtcctgaacatttcaccctctgtttattttttaaaaagattttatttattcatgagagacacacacacacagagagagagggaggcagagacacaggcagagggagaagcaggctccgcgctgggagcccgatacgagactcgatccccagactccgggatcacgccctgagccaaaggcagatattcaacctctgagccacccaggtgtccctgcttattttttttttaagattttattgatttatttgacagagacagagagagcacaagcagggcgagaggaaaagggagagggagaagcaagctccccatgtagagcctgatgtggggttcaatcccaggaccccaggatcatgacctgagccgaaggcagccgcttagccaactgagccaccagattcccctcaccctctgcttatagaacagaaccaatacattagtttagggtttgacaaggaggaggggggtctctctgattttctgtttgccaagaattcctcctcacatgacgtcatcagaggacagtcaaaaagcctgagttacttagaattctaactattgagtcaggttctgaagcatgccctcttgagggtagaggattgtcatttggaaatataataggaaaatttctttttcataacagataaattacttagtgcttctgtcctttccttctttttaaaaaacctacattgacgctttatttgaaacagttctgagtttaagggttctctccttaaaaaaaaaaaaaaaattaaataagctccacacccaaagtggagcttgaactcaaaccctgagaccaagggtcccatgctctctctacctgctgagccagccaggaaccactgactgcactggccaggcaccaagggttctttcttggatgaaatgagtgagaacccaaagcaaggaggggaaaaaaagaaaaaagatacttatcagtttgaaagtcccagtttatctttctacaattaaattaggaggagaaaaatgaagaacaccctggtagcaggaagaagcaagagtcttccagggtctggcatttgatgagctagatattcagttactatgcatttccacacgcatgcctgactccaggttactcttctgtcctataactacattgctggcaggactgttgttgccacagtagctggctgtgccccagacaaacagggtgtgggtctgttcccacagatctttatcccagtcttcatagcaaggagggcactgccatgtgctctcagccagtctcttgtcctaggtttctgatttggttgacaacatccttctcagtacagcctttatcaccacagcctgagggtgtgatgactgatctcagccccaggaacctggtggtgagcactgaaggacaaacagccaatttgcctcatcaggatgattctttctgcacttgataaggaaaccagcaggtccctatctgacgggttagaaacccatcacaggggcattgaataggttttcaggctccagggactcggtgtaagcttcttccgtgttgtacatgaaggagctgagcccaagcgctcggtcaacagccttctcgccgcaaccgcgccccagctccgctcacttccgactcctgacggtagggggttgtcctttccttctttattcaacaactgtaggtattaaaactgtagggtatttttaatcctcgtgagaaatgctcccttttttttgtttgtttgttttgttttgtttgtttgtttgtttgttttttaggaagaagcattgcaaggatctgaattttaaatgtgctttaaagctcaaaaatatcaggtgggatcccgtcatcacctagtggccaacagtggaatccacacttggaacaagatgtgagggaatttgtcaatttgggaaagtgccagcgtttttagcaaaaaagttagagaaaaagttaggcatacaaaagccaaaataaatatggccaaatgtagaggctttggcagcgccagtgcttcagtggtctggctctgcctttaacagcagccacgaaaatatgctaatcattgctctgtcactaaacaaaccctagtcatatttttacatgactgaatataaagaaaacataccaagagaaggaaacccttcaacatcaactttggaaagaagaaggactacataactagagagagttagtatctgtaaagtgaatgtgatcatcagaaaacatctagaccctgtgcttgtccaacagaacttcctgctatggtagaaaatgtcctgtgtctgagctgtcccatcaagtagccactggccacaggtacttttgggcattgaaaatgctaatggctagtgcactaaggagatgaatttttcatttaattttaaattgtttacatttaaattgtcctagccacatgtgactaatagctactggagaggcagagtagagtctacaatctttctctaaaaacatgtaggccctctcttagtagcttttggtggaggcagaaacatctgcaggtgaaaactgctagagaattgaaaagtgaaaaaaaattagagaagcaagagaagatggaaataaactgtcttgtctggtcacagctcattaaatttggggatatgagagtccccaaaacataacaagcccactagcaagttaataaaattacagaggagggtaaggaagcaccagcaatccaattctaccacatacagacgcctcaaccatagaaatgatcttggcaagctttcaactcactcagtttcaaagtgctgggaaccaagccaaaggaaatcacaaagacaaagagctcataaacttgacgaacacatttctcctggtacagaaagggagcgcttcagcacacctcctttcattcctctgtaagtttaaagagttttgccctgaagatcaagccagaccccctccaaggacagcactaaaaaggcccaaggtctgtccctccagacctgttacaatattagatctgtctggagacactctagactctgtagaacactttggaccaaggaaaatatcccagaattctaggaaccttgggatacaggatcaacagcaacttttaattaggaaaatctaatctaataagagggctatttttaatattgggacatgtggaggacaagcatctaaggtgacagcagttgagataacattgaaggagtgacgcctgggtggctcagcagttgggtgcctgccttcggctcagggcgtgatccttgagtcctgggattgagtcccacatcaggctccccccagggagcctgcttctccctctgcctgtgtctctgcctctctctctttctctctctctctgtgtctcatgaataaataaataaaatattttttaaaaagagaggtaacattgaaggagtttagtttacagaaaacccaaaaagtttcagtggtgatttcacctgtccctgggtatgttatttgactttactaatgcaactctggaaattggaaaagctaccacttcgaacctctggagttccacttccccacacaaaataataataataataataagaagaagaagaagaagaagaagaagaagaagagaatatgtaaaataacaattatgataaaatagttggagaacctagagatacccatcccaccaatagaactcattgacagtcaaaaggtagttaactgtgaatcatagcaatattaggaagattagctaatctttaagtagtacttaataaatgccaggggctgttctaagtacaaatatttaactcatctagttgtaaaaataaataaataaataaataaataaataaataaataaataaataaataaaatgtggctagcactgtacctgctatcatttcctcagtaaaagatcttgctaaatctatccttgactagcatacatgcatccatctggctggtgcattcttttgaataccaataaattatgttcaccatcagtttgctttcatttggctgccgcaacaagccacattggctatattaccacagtgacttcttccaccctgaggcataatccaataaaacagaatttaaacagatgacctgataggtgatgggtattaatgaaggcactcattgtgatgagcactggctgttgtatgtaagagatgaatcgctgaattctactccagaaaccaatattgtactgtgtgttaactgagtaaaatttagattaaaaaaaaaaaaagaaagagggacacctgggtggctcggcagttgagcatctgccttcagctcagggcatgattctggtgtggggattgagtcccgcattgggctccctatctagctatctgtgagactgcttctccctctgcctatgtctctgcctctctctctctgtgtctctcatggataaataaataaaatctttttttaatttaatttaatttaaaaaaaaaaaaaaaaaaagaagggtgcctgggtggctcagtaggtcaggcctttggctcaggttagttagtatcccagagttctgggatcaagccctgcattggtctccctgctcagtggggagcctgcttctccctctctctctgaccctctcccccaactcctgcactcatgctctcgctttctctctctctctctctctctctccctccctccctccctccctttttaaaaaagattttatttattcatgagggacagagagagcggcagagacacaggcagagggagaagcaggctccccgtggaagcctgatgagggactcaatcccaggatcccaggattacaatctgagccaaaagcagatgctcaaccactgaaccacccaggtgccccctttctctctttcttatctcaaatacataaataaagtctttaaaaaaaaaaaaagaaagaaaataaacagataacctaaatccaattcaggtattaaaattgttcattacactaatgacaaactaaccaggaatcacttgaaaacaattgtacccgtgaggaacttttttttgggggggggaagggagcatagcctctaccttgattgttgtggtgattacacaatgaatgtttgtcaaaactcctagaacaattcagctaagaaggataaattttactgggtataaatcatatctcagtaatactgatttttaaaaagtactgcacccaaaaactctgtcttcccttattgattttatgattaaaatttcagtaaacttttgggaagaaaaattcttcccgagatcaggcaaaagcctttgcccttgaaactctccacccaagaaaggataaaaggaatcaattggtatgttttaattctccatatcccacatccaaattaaacttggggctcttcaccaattagtaaaaacggatccaaatttatttttttttatccaaatttagacagtccttaaagagcaagatgcctttgcgctgtgctaatgcagcagccactagtgacatatggctacttagattaattaaataaaataaaaaataaaattccttaggggtgctaatcacatttcaaacgctcaatagctatctagggccagtggccaccatactggatcgcacagaagtagaatatttccatcatcccagaaagttatattagataatacggctttagaggctaaataggtcttcagatcactggagtctggtgatttaagacatacataactagggatgcctggatggctcagccgttggccatctacattcggctcagggtgtgatcccggagttctgggatcgagtcccacattgggctccctgcatggagcctgcttctccctctgcctgtgtctctgcctctctgtgtctctcatgaataaataaataaaatctttaaaagaaaaagacctacataactatatggcatatgtctctgagaattcaactggatggccttgctaacaaattaaaatcatctttaaaggatgcatattgtagctattctactgatgctccaataaggccaatgacctcagagacaggcaaatcaatagaggcaacccatggtggagtcatgaaggaaagtgtgttgctctgggtgcctccaaaacagcctccagaaatccctagtaggaagtttgccagcaaaacaaaataagcagcctatttgtttttaatctcctgtttcatgctttgcctagaactgttggcatttaggccaccattgatgggtagattacattggattgtccctcccctcattaaggcaagaagtatgcttttaaactaatgatttttatggaaattaagagactgccttattgataaaagccgctgcacaatcccccatttctggatcttactcaaaaaattgtttagagacatggcacagcagaaaacactactctttccccaatatccataatccctgattccttaatagaattttccattttacgagggcacatggacttccagaatcagtactagtttcccattctcctctccagttatgtacagtcacacataaattctgttcactaaaggagtagtggaaggggaggtgagaagggggatggggtgactgggtgacgggcactgaggggggcacttgacgggatgagcactggatgttcatcccatgaacactgggtggcaaatcgaacactggatggcaaatcgaactccaataaaaaatacacagaaaaaattctgttcagtaacctttatgcaaaacagctgtgtgcaacttctagaaagtgaccttagaaaaagggagatgggttcttctttcctcttccccctttctgctgattggaatatagacatgaaagctggaactcaagcagtcagtcatcctggacccgagcaggaagagccatgttgaagctggcggaacaagatagaaggaatctgaatccctgacactgtgagagaccgtaccaggcctggggttctacgtgagaaagacatgtctatcctggttaagccacgattgctctcccagttcaacctaatcttaagcaacatatacagcatctctggttcacgccaaaacataacaaaagtagactcacagaaatataaaatggagctctcggcgcgcacctccctcgagcagcagatccagtaaaatggcagaatggcttcctccagtcctggcacagcacttcactaactgctcgctcacaagctgtttatcttcttggtaatcgcaccttacgtggtgcctcgtccaacatcacacatctccatggtgcttgttagtaaggagcaagtgaggttctgtgcaccccagaaatgggatgaggaaggataccagacgccgctgtgtgtggcactgggcgcgtggtgagtgtagggccatcgctaatgatttcaggaaggacctggtatagacttatttgtggaaatcaatcaatatcacacctcagtggcagttacacatttcagtttcccgtgttgcatctacatgtgccatatacaagatttagtatcttcaaaataatttgcagtaccataaaattgctctttaaagacacaaaaaaaaataaaaaaaaataaagacacaacagtgcagtatcgggcatgtttacagttaaatggtgtcagatatttctaacacatcttttcttaggtgatgaatgtcacgtttgacagtgacagaaacagaacagcagctataataacaacagcaacaaaaaagtgcttacagtttagccaaagaaaatatgtaagaattcaccccatggtgccctgctttgctgacttaatggctaactcagtctaaaattaccaccattgttcgactttacaagtcctgcccagggaaggaaattggatactgacttcccacatactgatccaactggtgtgtggcagacgctgtggtttggctgaccccacaccatactcatcctgaccccactttccccttcccagacttccttgcaattaaggatggcagtgcgacccaaaagtctgctaaagaaacaggtatggctgtctctgtgactcacttcttccatcttgactgttgtcgtgatagtgagttgtagcagccactttggggacatgaggtgacaagtacacgcaaggaagggtaacgttgtgagatggtggagtacaaagatacagcctggggtccaatagcatcaacgagtggtcaaaccaacaccaccagctgtcttcctcagatttcttgctatatgagaaaaattaatgtctatttgtttttagtcactgttttttttaattgaagttcaatttgccaacatataacatgacacccagtgctcatcccgccaagtgcccccctcagtgcccgtcacccagtcaccccatccccccgtccacctccccttccactaccccttgttggtttcccagagttaggagtctctcatgttttgacaccttctctaatttttcccacttttccctcctttcccctataatccctttcactattttttatattccccgtatgaatgagaccatatgattgtcctcctccaattgacttacttcactcagcataataccctccagttccatccacatcgaaacacatggtgggtatttgtccttcctgagggctaatatctcattgtatacatagaccacatcttctttgtccattcatctattgatggacatcgaggctccttccacagtttggctattgtggacattgctgctatgaacattggggtgaaagtgtcccggtgtttcactgtatctatagctttggggtaaatacccagtagtgcaattattagccactgttatttggggttccgtgcctactcttgcaggcatttctactggatacagggggccctttaagtcctagggctgctttcttactctatcctttagcttatttcctgcaggtctctgagcagagattcacaacccaggttgcactttgaattcacctggggaacttttacaaaagtacctttgcccaggccccatgccaggtgaattgaatccacatctctgagggtgggaacaagggatgagtaatggtttttccccctcaggactcttttatactcttaaaaattattgagaatcccaaaaggctttccttgtgtgtattgtgttattgatatttatagtattcaaaatgaaaactgaaaaaagtaatagttattacttattttaaaaggaaataaaaagccacttttatatgtttaaaattttccataataaaaaatgtaaataaaaataacttagggaacaaggggggttcccccccccccgcttttttttaaatgtaggctccgtgcccagtgtggagcctaacacagagcttgaattcatgaccctgagatcaagacctgagttcaactgggtgatatgctatatgttggcaaattgaatttaaataaaaaatttttaaaaagaaaagacctgagctaagagttgaatgcccaaccgactgagccgcccagatgtcccaagaaatatggtggtgtttttttttttttttttagattttatttatttatttatttatttgagaaacagagtaagagagagcacaaataaggtgagggcagaaggagaagcagacccctgctgagcagggagcccgatgtgggacttaatcctggaagtccaggatcatgacgtgagctgaaagcagacatttaacctagtgagccacccaggcacccaagaaatatgtttttaaagacttcatagagggattcctgagtggcgcagcggtttagcatccgcctttggcccagggtgtgatcctggagacccgggatcgaatcccacgtcgggctcccggtgcatggagcctgcttctccctctgcctgtgtctctgcctctctctctctctctctgtgtgactatcataaaaaaaaaaaaaaaaaagacttcatagagtttgatctactccatttggattatgatttaaacaaacacacatacacacaacttaggacatctgaacactgagtggatatttgataataagaatgattattaatttttagatgtaacattagaattgtgatcatatttgtaagagtctttatctcagtgctacctactgaaaagttcacagagggaatcatgggatatctgggacgacttcaaaataatccaatgaggagaaaggagtcagtgaggtagagacaaaacaagactggccatgagttgaaagtttttatcaactcacagctgatggatagcagaagattcattttaccattctctatatgttagtatgtttgaaattttccattaaaaatgttctaaaaatagacaataggcatcatatagaaaccaggtaatgcaaatgagaaaaaacaaggttttttgacgttaaacaaaatatcctgattaagataaaattcagcaaacaggaagagggatttttttattaataaagcataaaatcttcactaaagatacagtcagggcccagttatccatttggcaaagtagacacacaaaagtccacagtacttttggggattcatgaaaatgtttacatttcttttaaaatagaaaatgaacttttagattgaagaaaatatctaaatatataatatgaatatatttatcatgtccaacacagtcataaatacagttctgaattttgtttttgaagaaagggtacaggaaggcaaatgtggtagggcctatagaaatcttaatgtggccctggctatcatggtcatagatgtctatgtgctgaagagcaaagcaacaagatacaaacaacagagatgctggactctagaattagacagctcatgaccttgtggttacaactgctgaacatgactttgggttggccctttgaggtgagggtgagtcaggaagtaccagtgtggtcatgaacagggtggttggatcatgctggtcaaatgtacagaagggggtctgtgtagagggaaaggtagcaagcacctcttggggtgtcttctcagtaaccctaccttatgtgggaagagtgcccccaacacctccctttcaccatcctagtgcttcatataagttatctgttgtcactgtgggccatcagccagaaaatgttggctctcagggggacagctgaccagaaagccaggccaatcagactgggactccaggaacctgaaccatggagcccagagacacagaggcggaaagtggattgcttgggctgtgtttgtgtccacactcagggacaaagtctatgaacctctgaggtctcagaaccacccttgctctcccctacaaagaggaaacacttctttcaaatactgagtaccccgatatttttataataaatttcctttggggcttaagctgttatgaatcagattttatgtttgtaacaaaaagaaactagctcagttgttagaacatgtgactcttgacctcaaggtcatgagttcaagccccatgttgggtatgatgccaacttgaaatttaaaaaaaggaaagaaactttagaagtatgggatcttgacagcagtaagatcagaggtttgaaagggtgcaagcagtgtgccccagacaccagtgtgtctgcagtaacaaagccagaagatttaaccaaggcaatatggccagttgccctcccttgtctttccagtgcagaggttgtcaccgtgacccacatagttggtcagacactctatggagtcccagccctgtagagatgcagtggcaagacctggaacatgacctttccaccagttgccatagtagccaatgtggcttttatctgttatattttagaaaactccacacctatttcatggcattcaaaaggccttctacttggaagtaagatgttactaatagaggggtgtatcggtggcccagtccattgggcatttgccttcagctctggttgtgatcccagagcttcacagggaagcagctccactgctcagtgggaagtctgcttctccctctccctctgcaccctccaacactcatgctcgctccctctctctcaaataaatacataaaatcttttttttaatgttactaatagaaaagaagccagagcaaaatagacacgtggattttcatgcacctgctacctgagggaaggcacagtgatgggctgactctcactgagccatattctgccatcgtggatactggagggcagccctagggggggggtgcccccagatgttgctggtcttcattcaaggaccagtgggacaggtcttccctactgagatagcagtcagctggcactgccagttcccatgaaactaccctgaggatgagaagaaataaaatgaaagaaagccaattgcaagcacccaggggtgatttctgctcacctgaacaggtttgagctaggaaacgttaccgcggcctatgacctgcacagctggccggggaaaaaactaggatatggccctaacagtccctgctgacaccaaacttgcaggaataggggcttcataaccacaaaactgggtcaccaccttctttctgaggcaactacagccttaccttggcccactccgttccctatccgtctctatctacaccactctgatccattcagaaactacacatcccagcatgcaacacagccaaggaggggaaggccttctgggataggtagtgctcccaggtacagtgatctaagtggtccaaattttacaagttgttttttgaccataagttaccatgtcaaaaatgttggcgcagggctaagatgcagctccaagagtgtgaagggctagagcacccatccccaggcgttctcgctaaatctcactaccctcctgtggttggttggctgggggtctgtgtctgagcccttcacagccttatccagcctgggtggggccttaatacacaaacctgtcatatctcttatctctccaaacatcagtagtgaccccctcctcactgcgttcaagttaaacttgtttgagaggcagtcaagagtttcagaaccagcccttcctgcaagagtttgtgttctgacccactcagacccaaagtagctctccaaagcctctctttttatgcccgccccaccctatccagaagcctccaatgcccacaatccactggagccactgccagcacccacatgtttagatctcagggcaactgcgctacccacacccagccccatcccaaaattcccacctctggagccctgcccttcaaatcctcccatctttccttagagccaggcccccgcttgccccggaggaggcagaaatcccgctgcaaggagagggctgtggttctggcatcgtcagcggcaacttggcacagaatcgcttgtaaaactgttgtctgggactggttggcattctagctaaataggcttttgtggattggcctgggacccaactgccgtgtataaatgttatttgagtgaatgtatggcattgtttccatggagaaaagccctctgagctcagagcatctgaccaaaagtgacctttggggacactcccctttgtgctttgggggcagcctctgtgggtttggctccagtttgagagccccgagaagcctcagcgctgggccagctaggctgggagtgagtgtggccgaggatctatgtaggtctgcccttccgtccagcggaggcccaggaggaaggggagaggtctgcccggagcatcaggacttggagattgagaccgaggacgtaagggatccagaaacccatgcaccgcctcaccccggaaagacgggatcaggggcttcccctccatgcggactcctcttgggtttggggagtggggtcgggagggttcagtgggtgacggaggaagggacagcgagttaggaacgtcttactccgtcttactccgcttgcgctttaggaggccggagtcttggcaccggcaccagggggcagcagaggcggagagatgcgctggcgggggagagggaggggtggtttttggtttttatctgcaaacggttttcctgcccaccgtggatttcaggctgcacttccagaccataaaagagcttctttgggggaagcctgggtggctcagtggttgggcgtctgccttcggttcagggcgtgatcccgggatccggaatcgagtcccacctcgggctccctgcttctccctctgcctgtctctctgctgctctctcttagaataaataaaatcttaaaaaaaaaaaaaaaaaaaaaagtttcctcctgtcgacactgagccagatccacccctccaagggttcagagattggggttctgtccttggggcggggacgatcaaggctgtgacgcctgggatccaccgggagggacggggcgccgcctccagggactcgggtcctgcaggtgcgcgacgctcaccggcacacgcgcagcccggcttccagcgaagaaggggcctccgggttgggaggaggccctgaaataagttttattctactgccaggacgggcgggagccaggaagtgctgctgtggggatgggaagccccaggagaggtgggaggccagctaggggtgcccggccagcggctgccctgaacagaagggccctgcccagacccggagggcacagagctactgagtaagccctgaaaggagccgctgggaaaggagtaagtgggggccgtgccgctctcggtgggacgagcactgggcaccttgacgcagagtagccgataatgcaggtgcaggtggccttggaccatacagcagccaggaccatggcatacttgaaggggaaggaggaggtgaccagaggcacaggggcaggaaacgttgtcctggacatgagcctcagtcctctcatttgcagagtttagaccagaccagggaaggcccccctttcaaccctgaggtccctaaagatggccagtgggggtgctgggatgtcgtgtttgacccagacacgaggaagacgggcacaccctcacccagaaacagcccagcacctgcatcacacagaagcctgggctcctgcctgatgggctcgtgagtctggacttgtcagccaggttttatgaattctttctgggccccagcaccacaaaaggacaggccctctgggcaaaaggtttaagccttccatttctggaaaaggctcagctggcaaagagggggtactgggcagggttggggttagggttgaaataacaacacaagcaccacacacacatgtgccctagaggagacgatcacattatttagccatcagtcagaaaggaaactggtcggagggctggacaaggtcccgggagtcccttccatccagatgccacacattaacccttccattatgggatcagggaaggggagagggtgctcaggggtgggaccagagtggccagggtggtagtggattgctcgggggctcagagccatggtgactggctggctgataaggacgagttttggtattttgacagtgctgaaagcagccctgctctcacccctcacccttccactccccctgccccggggggaaggggtgggaagtggtggaggcctgctcaccaggtaacagtcagttcctgcaagtcccagaccaagtgagacacagcctgtgtgtgggtcggggagccaaacaccctggtggagccgagaaagcccctgggcagagagagtcagaccctgaggcaaaggagaccatatattccaacattcacagtgggtgctacaggcaggctgagggagggggggttggcctggaaacggctccccatagtcgctgaggaagccctgaggcaaggagtagggtgagccctgtctccaaagtctgctggttcctgttggcatttctctctttatcttttttgttttgttttccgctctttaaataattaattaattacttttaaatacaaaatacacagtgtcctttctcttctcttctgcttgtttaggggcgatcgggaggtgagttttaaataagggtcccggctgcctaacaggtcacaggctccgggtgggagggccaagagccccaggtgccacccctcccctggggtgcccggcacgcttcaccctcccttggtgtgccccagactgggggctctcggtgccctggcccaaagccctctagatggtgaggagccctcttgggaggtggcacagagctgatgctgtgagattcctggtgggcctgctttcggcggacagagtcaggcagagaaggtcctagcccatgaagcacacaggccccaacagcacccctccccgccttgggggggcccccaggtctgagaaggaggcgtccagcaccggtagctgctccagcacaggagtccgcacctccagcaccgtccggccttgctgtgtcttgagaggaagatggaagagagggagcagtgagcttggtggaggcacacacagagcccacagatcccccagcctcaggcccaggttcccctctcctctgaggccctgaggtgctatcccccctactcctctgcccatccttgtcatgtggtcagacttgctagattttcttcctcaaatttcttccagagagtcaggattaggaaagctaggaagattggatttgtgtgcacatgtgtgtgcacgcacacatgtgtgctcatgagcctgtctacagctttgggttcatcttggagatcatctacctgtggtagttgtgcgagtctgtgtgaaccccacgtgtctgtggtgtcactgtgtgatgatatctgacatgattccacatgtgtatgtccatgtgtgaccctgtccaggcaactctggggatgtctgtacaggctgggagtgtctgtgcgctcctgtgccttcagggtgtgggaggtggtttgcacacctgtgtgcttgtcgggcaacctgtgtaaatgtgtgcacgagcctgtatgattcactctgcatgctgctggtgggcgcaccaaaggtgaatcccaccttccatctttcccaccctcctcgcccctgtctgagctccctcgaatacatctgacaccaagaagctggactcctcctggtcttccaggtgcctctacccaacaggtcttctgcagcctgactctgggatgcgccccatccagctcttcctgcctcccacctgacagccatctctgaattccttgacataggggctggtctccaagctcagctcatcctcattggccccccggagcttcaggggaccctctcgggccacccccaagcatgggtaggagacatcttggtgggctgagacgctgagcagccgcaggaaggtaagctggaccacaccaatcggggagccctctgagtccacgtaagagaactggggggagagaggacagcgatgaggggcagacagagcagggcttgcgaagcatctacagacacaaggtccccagcccagggttcttggtggggactcactgggcagaaagggctgggggataaatgggccagagtgggagacagggaggacttactgagggcaaacaaaaggcaaactctgtcttgggttgtcaagggaaggagacagagtggcagagggctggtaagaggataaaagccagggaaagaaggggcaaaggctctgtaggggccagggcacctgtcacataaacccagaagccactgggctgcacagaggagcaggggaggaaagtcaggggccagctctcacttgcgtgacatcatctctgggagtcacacacgtttcccctcctgctgtaaaattgcagaaaacccggaaggcatcccgagcacagccctggttggggtcaacccagtactctcctgtcagggaagggagaaggaagggtcagggcccccacaggcaggactcaagacactccttgacccctttcccactccccgccctgctgttccaaaccccacttctccccaccacgcccttggtctcccggccccactctcccccagagtccctacaataccacccccacccatacttcattccatcatcaccctacactctgcccatctgagggaccccttccctcagcagtacccccaggctcccacaggggaggcaggagcactgacaccctcacatcagtacaataggtggttgtagatgcacacatgtgcccgttagtataaatgcaagcacaagtgtacacatgcatgtgtgtgcatgtgtgccacttcctgtaggcagcgggctgatcatgagctggtgcacactgggaggaccagatcagccgttaaatattgaaatacttctgacctggttggtaaagaactgctgtcccaagccccgagctccgagcccccaccccacaccttcccccaagagcccctacatccatctggcttttcattccgttgtctcctgagcctggcactgaccatcaggcagctctgggtggcagagcttcaggtcctggcaggtgcgggcagggctgtcctgggtccctgtcggccgcctcatctgctcaatctcctcccgcagggagtcgagggaaccaaaaatctcctccagccccccagcactgcccggagcgcccccagccggtatggcctcgtcctcctgcatcaggcggcttccatccaccgagcgccgagtcttcttgggcatctggatgggcaggggctggatcacttcgcctggggggccctgggtggagggatgggtggagagggtgagagacaaggatgatatgagggggaaacgacaggcacagtcagagaagcaggccctgacttgtaactcaccgggtgtcctggaggaccctggatgcccttctcgcccttgggtccagctgggccctgccagaggagtaaatgaggtcatggtggagtcaaggggtcaagcaagcaatgaaggtcacagaagggtcaaatcaatctctgggctgggaatgaggagtttccctgggagagagcatgtttgccctggaaagtgtcaagtctggctggcggaagggagcagagctcagagttggctggggcatcactcactgtggctcctttggctcctttggggccagcaggtccctatgaaatgaggaataagaaagaggtagtcaccacaggggacggttgggatatggaggaatggagaggcaaagtcatgagtccacaagaccctggctttcctacaggatgggcaggcatgaggggactcggagacatatgggaggccctggaagggtgggggaggaaacactgcaggtgtaaggacatatggaggacactggggcctattcttgtttgctggctgttgccatggaagccattgggggattatggaggggggagcattggggtttaggggatttaatgaggaacagatggggtactcacggggaggccaggaggccctccaggaccaatagggccagatgctcctgggataccctaggaagaagagaggcatggttcaagtgggtcttcctccacatcctccgtccccctacgctgagtctccattgccaccccacccacccccaacatgaatccccacactcatcctcccagaccttccaggaccatgtcctcaccgtctctcccttctgtccagcagagccctgagggccaggaagtccccgatcacccttctctccctgctctccagggggaccaatcagtccgatgagacctgggtgaccctggaggagggacaggtggtcagggggtggcaaagaggagacacagggatgcagaagaaggaacctacaagggtcagagcccagaagacaagagagactcgggcccagggtctgagtaaggaccctccaaagactcagtgctggaggtctgaagcacagtgctgggcactcagggtgtggatgaggggagatgcccagccataagtctgtcactcaccttctcgcccttggctccaacatcaccccggaggccaggaagccctgggggtccctgtggggagacaggaagtcactctctccatgggaaggtgggaccaagctctcctcactgccatttcccacttggtccaaggcctccgctgcatgcccactgccaggcgacagcaccatcgtcctcacccccaccctccccacccaatccacaatcactcaccacaggacctggaggtccagcctggcctgtggccccaggacggccttgctgaccctgcagagccaaagggaccacagaggtcaggagaactgtcctcatatgggcaccctccaaaggcccctgacccctcctaccccagccaagcctctccactccatgacttaccactgagcctgggagtcccctgagaccatcaggaccagttttccctgctgggcctgctggacccacagggcctgtcttccctggggcacccacagcaccaggatccccctgaaacacatgcacggaatgagtcttaaaatgcagaggaaagggatatggttgggggtaaggagttcaaggcagatgggatgaggcagaaaggagaggctagtccccaggagcccctggagcaggaataagtatagggaaccctcatcagggcaagaggctcaacatggaggagctcgacatgccatagatgtctggagagaggaatctgagaaaccagaagtgccaggggatagagggaacactccagcattcaggatggcctctccctcaccttggctcccttctctccttgccgcccctcaggaccaggcatgccagcaggaccctgcagatgaagacaggaaggaaaagctgataggtagggagttgccaggctcaactgctttcccctcctgtccttctggcctccagtgactgtgcgcatgtgagcatgcatgcacacacagacttccttgtgcgcgcacacacacacttgtgcatgcagagtcacagaagctgattcacagacgagctggtatagctgtaccacttgttaaaatactgaggagttctgtgtattctgtgaagagccacttgcccccacaccatctagtgcccttctactgcagcaactggagagttaatccagttaatccaccgagcgggggggggggggggggcccggggaccagccaggggcctagcccggggcgggggcagggtggggaagccctctgggaaagctagccccttcctccagtgtccactctgatcagttggtgattcccaccacccctggcaagaagatacatagcaaaacccaggaatggacgaactcacttatatagggcacactcacagatacaaatgttcacacacatatgcaccccatcccaggcacctccctgcccatcccatttgccactcccctctatccaccctgcccagggactgcacttcaaggtcctggatgtccacctcacttacccgctttccaagtggtccagggggtccattctccccagtgggaccaggagatccctatggagggaggaataaggatgcgtgagcatttagcttccagtccatggaactttcaggagcagggcatcaaaaggggacaatgggcctgaaggcttgggctcagtggtgaagggagggggcactagtcactcacaggctgtcctggctcgccatcttctcctcggtcacccttcgcaccatcctggccctgcaaggacaaagcaaggtcaagggttgccacaacctggctggcatcacccccaaaagtgccaatctttccaactctctgcctgccctgccataccccccagcttcccacactcaagcccatcagccacacaaagtcctgtccaggtacctactctctatccgccattctctccctagggaagactcacccgagggccgccttctccaggagggccaggatcaccaggaaaaccaacaggaccctaatgcagagaacaaggtcaaggtcataagcccctaagcctacccagaactaacacagacccccatgtcacacctctccttctctgcccatagtgcccgcctgcatgccctgcgaaggtggtctcctgcacttgcttttcctcacttcctgcacttcatgctttccgatgctgtcaggcaatcagaaggcatctctcactttctctggatttcatatgtcccttccagaagacctcattcccagagcctcccacccaagtatcccccactcttgggctccccctactccaagatcctctcactcaaacacacctacattcccaggtctctcattcacaagcctccccttccagccctgcccccccaaactcacagggttccctttggggccatcatcaccggtggggcctttgggccctggtggtcctgcctctcctggttgcccggactctcctttctccccacgctccccgcgtggaccctgaaggatgagtagagggtacagatggtcccaaagggctctcgaaagtcaaggatgcagcccctgcttccaagacaccttcagcctcccctctaccccctcagtgacagcgggatgcatacatcaagtcaagcccatagggagtcctctggtccctcttcccttcaaagaaagagcgtggggctcactcagacccagaggtccagcctcacagagtgtcgggggcacaggctcctaggctgtggaggggctccagctccaagagatcacagcaaccaggggctggggttgattagggtgatggggattagggagcagggtctcagagttttcactcaccttgacacctggctcaccctggacccctggagatcctgactctcctggctccccctgcaaggagactggggtcaaacacttccttccaccccccaaaaaaatcctgatatttcagtctctcacatataattctctcttgccaaaactggcagaaacccaacactcataccaccccgaagacaagtccattcactcatctccttccctgttaccttctctccagggggacccaggttcccaacacctcctgggggaccttgtgggccctggaagaggaacagaaataggagtcgttgcttaaaggaggaggtgccattccaggggcagagcctgaatgaacacccgagtcatagcagtgagacagtgggaggccttccagggcaggtggcttctcgtggcagctgagatgagactagagtttatagtctagggaaagggaggcaggactggccatggtgatctgcagggagagaggctgagaggactcacatcagctccattgggtccagctgggcctctaggtcctggggggccgggtggtccctggggaaacagatacagcaaagatggggaagcgaagagaaagaaagagcagtaggcacataagaatgccagagggttgggggaggcagacatcttgagagggtggcaagagaggggggcagccacgccagagagcagccggcagggagcaggggatgctggaggtgctggataggggtgactagtaggtggggttgggcccagggggtcgcactcaccatagggcccacatctccggtttctcccttctcacccgaggggcctggcaaaccctgtgttgggggggggacagggtacagacacagatgaccaagccaccagagcacagctccaagtagacagaccctgcagtgcccttcccttccatcccacatgccccccagtcctcagcagcaggggccagtagggggcagcagacccatgctgacctcacctctcagcccctgcctctagcccccaactcacttgcaggccaatgggtcctgggggcccattgaatcctcttgttccttcatcgcctttggccccgaagtgtccctggggtccccgagctccgggctccccatctgctccctgaggtggaggaagggcaggggcaaggacacagagatggtcctgggtcaggagatctctattcccaaaccccacatcgagctgtgcactaggcccagagccccgtccccacactcagccccaggggcgaaggggaactgggggcagattggaggctgcccacacctctgagggtggggatgaggcatcagtcactcaccgctgctccaggctgccccacaggacccaggggcccagggggtccaggagggccctggggagaaaaggagagtcagagagaccaggacagggagagagaccaggtggaaatgaggttaaaggcgagaggtcagaagtcaaaagtcacagtcacttacatgttcacccttattccctttagtgcccttctgtccgggatctcccacctcaccctgcagggacaaggcaggtgagatattagcataaggacctgggtaggcagggaaaataaggcaggggtgggggggtaggaggcgtgcacagatcaatgatctcatctggaaagactggcccagggtctgtaagtccccacaccttgtctccatcctctcctgccacgcccgggggtccagcagggccagggagccccacgggaccctgtaccccatctcggccagttggaccaatggggcctttctcaccctgtaggaaatgaagaaagaagtcatgacccggagacaaccctcatcctccatggcccagcagctcacagctcacagacccctccccagtgtctccccccaccaacccggggatcccgcactcaccgggacacctttctctcctgcggctccagggggaccctgtgggcctggtcgccctggggggccaatgggtcccccagatcctgctgcacctcgctccccaggggagccctgagacaggaaatggagtcagacccccaaggaggacatcacagcccacccacatcagaggagtcctgaccatggttcccaggagaatagcccaaaattgaacacactatggctgatcctagataccctctgcccagtcccacagcctgcctagatccagatgccactcttcatccttccttacccactctttcctggttcctccctcctgccccccaaagcccccagactcactgcagggccagggggaccagccggaccttcgtttcccttcaaaccgagtccaccctatgaaccagagatttaagcaacagatatgagatgggaaggtgggatattttaagaatgagggtccaagggacacgcagggaaggacaaggggagggaggggagacaggctcagggaaacaggagtgggggtgatgcccagtgatttgtttctcctgctgggagacggggatcacactcacggcagtgccggggaggcctctctctcccgggaagcccctcagaccagcaggtccatccttccctggggcccctgggggaccaggatcaccctaaaatgaaacaaaatgtgatgagccacatagccatgctcccaaattggacagagagatctctggcctttgtcaaatccccaattatctgttccctttagcaacgtccctccacccccgactctagtcctcacaagttcccctctgcctgaccctttactcacctttgtcccttcttttccagctgttccagtcagtccctgctctccagggggtcctgggggccctgggtgacctcgctcccccatgggccccgtctctcctgctgctccctggggatgagacggaaagactccaagctcatcctctgccccttggccaaagaggccacccttgccaccctaagataagccccctggagcccttatccctgccccaaggctattgaggaattcctggggctctcctaggccgctgtgctggggcctaattccccagtttgcagttaactgcaccacccagggttcccactgcggaactgcccctctgggacacaatgagatgagaactggcccaggaaccaggctgaagttgagatccctgctccaaatccccacccagggcacctggggcaggtagagcaggggctaggccatgtgatcaggaaaagggaaaagaggagcagatgacctccacggtctggggtccactctcccccgagggcagacatacctgaggtcccaccacccctggagggccaggggggccagtcttcccttggaaaccctgagagaggaaggagagagagcagtcaaagcacgtcaggcatagacactgggatagaccccaggttcctggagaaaaggcagagtcaccaccgagtccttggtcatgggtctgagcagcaccagcttctgactctgccacaacaacctccctggtgggccttctagacggctctggactgtgaaggtccgagggggccaggtcgttacttaccacttctcctctctggcctgggtgtcccggcagcccatccttcccagggggaccctggaaggggtttagatgtcaagcaaactctgggctgggaaggaggatggaggagaagaaggattcatagaaccagaggccgtcagaggtcagaggtcatcttaccggaggtcctttggggccaggaaatccattggggccttggggtccagggagaccctagagacagagccgggttgaatcaggagaataagcaaggggtgcagcttcccccaccctaccccaggggtgagagatgagggcttcactcaggcccctcaggaagcgctagggagcaggagactcaagctgcactcaccctttctccagggggtccatgggggccgtcaccacctgatgttccctgttgggggaagagagtcagggggaaagaggaactgccttctagcatctggaggtcagaggagggagaccacagggagctggattaagcagcagatggcagaagaagccctgccaagaccactaaccttagctccagacttcccagtggcacctcggggtccccgctgaccccgtggaccctaaagagaggggaggggagttgtcagaaaaacccaaatgcacctctttggctcttgatttccatgtctgccctccacacttaccgtggggccccgctctccccgaggccctgatttccccgacaggccctggtgggaaagaagcagaaacaacacctcacccggggccaattccaccaacagagcagccctgcactccacaccctctcccttccccgggcttacccgggctcccttctctccactggcgccgggaaaaccaggaaatcccagagacccctgatgaggtggagagaaggaaagatttgagaagtcctgaaaagggggcagcagggtgggagatctgggctctaccagtaactaggcagccttggacaacccccagtccgcccctgctgctctctggctctctattctcccatctgtagaatgggattaggctaaattcgctctagggccccccactgctgtcagtctcttcttcctggaatcaggagtcagaggagggaagaagaggaggagacacacatcgggcatcaaatcaccttgggaccctggcgtccagggtagccgggcagaccaggaacacctaacttgccctgtagagagacagggagcaattaggggcaagaggagtcacagaccatctatccatggagatcccaagtcccagagacaggagccagctcctacccatcaaggctccccagcaaaccttcagccccctggcccctcatctcgtactccatgggctgcctggcttttgtaatctctccttcctgagagtggattttcccccactgatgctgggcatctcacctcttctgtgtctttaaatccgtggctccatgaagttcctggggattgtgatctagcccttgcctacctgtggacctcagcttcccttctccggcacacactcctactccaccaagaccagtcccctggcaggcccgcacacaccatgctcaggatggcctctggccatgtccccataccaccccaagtccctctggcacgcacccccttcctcctgatgcttcagggcctgccttgcccagccagctgcggagcagaggttaggtggagggattctgcagcctgactactaggggtcaaacccaggctatgcccttcatgggctgggttactgagaagcatcttcacttgctgggacttcagtgaaagctgtctgcaacaggaggctgtagggtggctgccccacaggactcataagacaagcaggtgcagtgttggcactcagtgagggcttactgacagctctgcaggtctgttcttacctcctctgactcccccttcttggaattcctgctgctctgagtctggactcatttccattctgcctcatacctacattccttatgccagcttcatgccttgtccccacctccgtatcacgtaaattctcacgacagactattccatgacttcttctatagccccacctccactccaactgtcagtggaaggcgatgccttctacagagaggagcataattaatatataatggtcttcaaatgcctcattgactccagctattggcatcccacgcccatcctgatccagtgcctaggccctcatcccctccacgttcctgtcaccttttcacccatgagccccggtgggccagggtctccagtgggtccagtacgccccttcggcccctcaggtccatcttcgcccctggaaccaggaactccaacctctccctgggtaagaaggttgaagaggtgtcagggactggtggcattggctgggccccaagaggagaggtgggcctcggtgaggctgagtagggtcccagaaactactgcaggacaggaagccccacaggaacaggaagagtgttgtgactattgggttggtgagatgaaggctgcagggtcaggctctaagaggagaagagcacgggagatggggagtctggggttttgggaactaggctggtaattgggggctccaatatggaggaacatcaggacttagcattgggggccatgtgtgggtttctactcaccctgtcacctttcacacccatgtcccctttgaacccgggaaagccatcctcgccctgagaaagacagggatgagaagtcaccagagatgatagggggcagtcaggagataaaatggagcatttcagaaaacatgggtggaagggtagatttcaaagctggagagcagtgcagggcaggctggatggaaggaagtggggggaagagctgggcagaagaggtgatggggcaggatggaggtgctgggtagctgggggcacatcactcaccttttcacccttatgaccctttagaccacgaattccatccacaccctagagttacaagggagacagagagagagattgaggacggaggttaggttggaaggatcgagctcctgagatcccagctggctgccccgacatagtcctttatctcccagcctagttgtccattaccttaacgcctcgaggtcctgggtatcctagaggaccctgaggtccagatggaccctggaagaagaaagaaaggtatctaaaaaggggtggaaccctcaaggggtggaagaaacagtagagacaacctcggagtctggatacctagaatacttcagagccacatgaatgataaaacaaggaaattccaaggactttgaggccctagagtctgggtggaaactccctcaggggtgaaagcaggtatggaagatctcacctggtttcctttggttccagggggaccttccttcccagggtgaccctggggatagggaaaggagaatgtgaccactggccactgtcaccttccctgcatgcctccctttacttctttaacccaacttctccttgtgaccctgatgaagccaactgaccacgggcaggcaccaccagtggaccccccagtgtgaaggacacactgcatagatggtcaccaaagacatctggaggtcattcactggggtggagagtcaagttgaatttggattaagaggtgggcacctactcaccggaggtccatctgagccaggcatgccagggagccctggtttccctcgaggaccctgcaggaagacaaggaggctcagggtcacaggaaggatcagatcagaccatggctgaagtcctagccatacatttaaggctcttcctacatccctccagcacatgccctgtccctcaaatcacttagtcacttactttctctccatgagggccaatggcaccctgggggccgggaagaccctacagggacagagagagagagagagagaggttacaggagcctcacaggggtgggctgctctctcccatagccaacatccccgttcagggcatgagtggtggggcttgagacccttaatttccatccaaggtctgacccactggggaagcccggatggggacaggttgcacaggatggctcacctgggttccaggagtgccctgttgtccaggaggtcctggctctccctggggtccctaaaaacaagcaaccaggtagaggtcaaaagaagatggggacagaacaaacttagggtagagacctgagtcccaacagggacagcaggagggcaagaaccagaagcaggtggcgggagggtgggggggtgggggttgtcaaaatgatcaccaaggaaacaggaccttggctaacattcaggtggtgcctctgtgcccattactcaccaagctccctttgggaccatggggaccatccatgcctcggactccctgaaacaggagaggggcatgagcaggctggaagatggggccagggccctgggcagacctgtggtttctgagagacccggtcattccagagggtgggacggggcagccttacattggtcagacctccagatcatcccaaagctaagcaaacacagccagcccagatctacagggcgtaggtctatgggtctgtgggtttgtggggttttgttttgtttttctgcaaaaaatgtnnnnnnnnnnnnnnnnnnnnnnnnnnnnnnnnnnnnnnnnnnnnnnnnnnnnnnncactgtatcatatgaccctagaagggcacctgggcttatatgctggagcagagctaggttggggcagggtgggggacctggaggtgagggaagagaggcagctaggaagggtggagtgttggaaaggtcagggggtgaggccagggtcaggagtcaaggatagtcacataccgggggtccaggaataccaggtgggcctttggggcccaggagacctcgaggtccctgcaataaggtgagggaaagatatggtatgtgtgggaaagagataatgggtccctcctgtgtccatacccctcccctggcagcccccagagccaaccccaacccaaccccctctcaccgactctccaggcagtccccgaggcccaatctccccatcatctccctggaggaggaggacatagtaaatcagcttcaccctccacacttctcccataccaagcccctgtcctggccacaatacttacccgctctccatcctcaccgggtgggccaggaaggccctgggcaccagtatcaccctggaaaatgggggactaggtaagagggaccccagagcccccagtacagccagacactgaccctcttaaattaaccaaccagtttcatccattaagctcctgctggcatgctcagcctccttccctcaccttgagatccctcctccacaccactccatagaaagttcaccccctcatcactcacaatgcattacccccaagatactcaccctgtgtcccttctctccaggtagccctgggagtccatcaaaacctcggtcaccctagggaaagaggggcaggcctaatgaggtcccagcccctttcccactccatccacccctactgtgtcctgcatggagaggtgccacttcatgggaaaccttggtcaccccaaaaaaacaaataagcttagatggggctggaagtcacaggcatcagaaagggacccatgcctggtaccttcactccaggctctccaggcattcctcgggctccatcagcacctgctcggccctagggatgcaaagcaaggctcagagcaaacagaggcacagtcccccacaccccgatccctgtctcctaccgacacccaccacaccccactcacccttcgcccagccttgccaggagggcctgtgaggccttgaggtcctctggggccctggggagggagagtcaggagcagggttaaagagcatggaccaaaagggaggcactggatgggggaatcagatgggtgggacttgtcacctgaggtcctaggtctccagattctcccttcaggccagggctcccaggttgtccctgggacagagaagagaggttggctaagttgaaggacacacccaacaaggacttcaaagccctccccaaaagtagcaaaataactttcaacctggtccctttccagaactgtccatacccacacacacaaataaagaactccctatcccaatacccaactcactcaccaagggtccagggcggcctgtgtatcccatggggccagggggtccccggagcgccagctacgggagcaggggacacagtacagctgaggaagaggcagcaggagaactccctacgccagtacaccctccaaattcacccctccactcctaatcctcactttacggtcttggattctccccaacctccctctcagctccaaatcaacccagaccttaccctgccccacatttactccaacctacccttccaacccctcctaaagtcttcacttgctctccatatccctcccttcaccaagatcccttctagacttactcacccgtgcctgctgcagaatcgcctgggcctgagcctcctgggctgccaccacaggacccttgtcacccccaccactgccaaaccggaactgaggggtagagagaaagaaaggtccagattctcttccaggaaacccatgtgaccctcccagcccaaggcttcatccaacacttctgccccatctcccaggttcagggacacctcccaccccataccctcctcgagtgtctccatggaaggttttagagaatcatgcagcagttttcagaaactctactcctgtcttcctcccccgctctctggcttcttcctctagaaaaactgtcctttggttctagagtccctgaaacataggattttctgcccagttctagatgatccatgttttgttctaggtcatctaatgaggcctagtccatccaactcaaagatcaatttctttgtgttgatgttctttagagattcctccttagtttcctggtctcctggtttttggtgatagaacacagttctcctgctgttcccactccaaaccccagaagacaactcactgggagcataagagatgtgccaggagggccaggtgccccatctgatccagggagtcctgcccggccaggggggccctggaatagggagaaaatgaacataggtgagagttagggaatgttagggtcctggcatcattataagagcctcttacagaataaatatagacttatttacatctttcctaaaccccacccccaccccatacagaaaatgagggcgagacaccagattactcccctctgtaaccagaggtgttaggtcctcctttctgggtgttagggagcacccttgttcattaatcagctagctaatgaggaactgctgagcttggtaccctgttgagtactagaggctccactgaagtcctacacaaacacagagacacacagacacagaggctactctcttaccctctcgccagggtctccaactgggcctgggttgccctggatgccagggggaccaatcaacccctgaggaacaaaaaacaagtgagtcagctgagggcattcagatagaagagggatatgtggctgcggggtcgtctctacaaaagagatttgaggatctgggaagctttggaaggattctccagagttctgagaaggaggcctgggtatatgtgggggaaggcataggtgagtgtgtaagaagggtctctgagaaaaggctaatgggtcacagctacacttaccgcagggccttctgggccaggaggcccctcgactagcattccctgtagagtcaaaggttaaaagtcagagactatagggctagcacccccacttccttttcctcttccccctgcctttagtgactaacagtgacttacaggctccagcaccgcgggttctcccttctctcccttcagccctcggggtcctcgggcagcctgaaggagacacacatgtaacccccagtggggcctgtgagcagccaggacaccagggctgcccccatcccaactcccaccttccttcactctcagatcctctggagacctctccaaccctacgtataaaatcccccagccctcccctaagactccctcttcacagaccactcaggccttccaaggccttcctgcccttccacagaccacagggctctccacctcccaattcgcagccccatcttagcaaataaacttcctcatatccttgtggacctctttcaggaaggtcttcacacccttcctggaatcccaaacccttcaaccttcccaaactctcttctggagaactttaccctattccccaaactccctctgagtccaggaatccttagaactttaagaaactatcaacttcctccaccttactgcaagccaccaaataagcatttctctaagattgtggattgatttttattggggtttaaagggagggcatgaatccatataagaatctgatataatccatgaagtcttttccaggaaagaaaaagtatatgcccttatgcacagaatttttcttagaatttcaaggggctcacaagttaaaaactctccagaagttaaacatccatactgtaagtggaattggagggcagtccccactgatatcccaaactcagatctcataactagttttgggaaaaatatagctcttgggctgttgcttaagccccagaacagactccctagttcccctcccagcaaggacactacactcttcctctggccctcatttatattccaaacccaaccagttctttctttttcatacttctcagatgcccacccccaacactaaggccagaaccaaaataaggatgggaagaatggaaattactctccaccactctccaactctcccaacaaagatcttcagaatgtcccctctacctccatcctgacccaacagcaatgatgaatttccaaactcccccatatcccagatcaaccccaaatttccagaaggcagcaaaagggaaaggagcatagagtcagggtggcaatattagagaagggaagtgtaggatgaggtagcagggtagaggaggcagctctaattgcaaggcaagcaaaagatgaatggcgtaggcaggaaatattccaactgagatggagtggttgaagacatgggaaacaattaagggagacatttcaaagggacaaacacttggaagcaaaaatgaggtcagggccaagaaaaattaaacatggccaagagggctagaaaatgaactagacaaacaggaagtggctggacagacaggaagcagccaagaaaagaggatccaggaagtggaccttcaacaacaacatggctaccatgacaagagaaagaagaagctcacaaaacagacaaaaagtgactcctggagaggggattatgacaatgaaaggcaattcttccagaaaacacaaacatttaggctagtacacagaggaaatagccatgataaatatctaggcccgtaatggaaacttcatgatttggatgccctgaaacacacaggaagtggcttattagcaaaggaaattgttacaagacagcatgaaaaactagagccaaaacataaataagtccctttcagtacaaactgtcacagtcaccaagatggatgccatggccaagaaagacaggaaaggacagacagggagtggcctatcagttagaaaacgtgacataggaagttagaatatttgacagcaacatggataagaaactgtttttattaagaagaaatgatggagacagattgacaatggacaaaaagtaggggcttattgaccaaaagctttatgaaatacagtttggttaagatagaaagtggccaagaaagacaggaagtggccataggattaaaaaagaaaaaaaaatcccaactgccctgggcagagggatccacaaagtgatacagggcaagatatttggcgagggaaagcaggaagttatccttttaagcaacatatacatcttacatgaacagaaaatggcaagtcatcaatgggaagtagcttgcagccaacagacattaatcagaaacaacaggaagcaattcttacggctcccactggagatcaagaatggaagaggagctcctttcacttacggctcccaagggggctgtctctgcagacaaggcagggccaagctccgtctcctcacgataatcatccccatagccataggtgtaatcgtagggccctgctggggggtctgtgccaccctccccatattcctctgtcaggaacctgtcggctgtggaggggacctggagatctgtctgctccttcccggggatggggagggagaggggtagatgggggcattagggctgagaggaggtttttccctggaccccgacggtgtggcaatttctggcccaaaggattctgggggtaactgggaccagagattttctcccaagaagatcaagggaagtggttgtatagaaaggggagggccatcaaaggcctgaaatgaggagggatgcccccaaaattgggcctggagggaagaaatgatgaattacaagtaggaagaagggtggccggagggctggacacagagtagacagacagtctgcggagacaagggaatccagagaataataaaagaaatggagggaaaaaaacagagaagaaaaaaagtgataacagcactggacagcagataactcctgggaagaaaaatatgataaaaacaccaacatggggaggaggttgtcccagaatcaaagaataatggcaggagacatggacactgaagaaaaatggctgtacttagaaaaacaagcagaccaataggtctggagtgactagaaggccacaaatggagatgacaaagagccctccggccagaggaagggctgattcaccaagatatcatggggcaagggggctgggtcacagatgcccactgcccccagctggggtgaaggtgggggatggagttacctcctcaggggatggcaagggacttgattccaggattccttcctcttcacctggggtggggtcctaaccccaaggagagtggggagaagagtaacatggtggaaaggaaggagagaggttagcgggaggggaggcaaagcagcatcttgtcccccaccgtgcgcagtatctgtctgtaccgtaccggggagtgggggcaatctcagatcttgcagcccctttggaggggggacagtttggggagagtaaatctccaggtcatagaagttaggggacacagatctggatgccccagctctacctgccggtaactgcttcctctggacctggggggagcctgggcagtggggagaagatgcctgctaagctgggcatcggaagggggtaggcaggtcccgtgctgggccagaacctccaattctagaggacctccagcctggtgaggggggcgcctgccaggctgctgatctcttggcaggtggggtaggctttctgggaggggtccgacaccccctgggggagggggagccctgcggttggggcttgatggcctctgtagcagagagacatgggaaggcgcagtgaggaaactcccataatctaaataaatgatgtctctccctacatgttaagagggaaggaaggtgtcttaggagatctttacaaggggtgatgggaggaaaggaagaaattaaggggtccctcatgtttacctgataatcaggggtcgtctctgtagtcatcacatcgtaatagggggtctcgtagttatagtagaaagactcagtggactaggatttgggaaagggcaatgggaatagtaggaagaggtaggagtgtaagggtgaggagagggagacaaggggatggtgtgggagtttggaaatagggtaggagttggggatgaaaggagaggttaggggtcaggagagagaagaggagaggtagaaagggggggtgggtcccacatgtgggacagaagcagacatgattaagagattgaccttccaaacttcagaccactgatcccagatcatatctgtcaccctaaccatctggaacccaagcctcctccttccccctctccccagccctttaccctgtaccttccaatgaattccatagaattccacagaattccacaggcccagcactctttcaagattttccctatctcctgctcctccccatttctcctcctaagtcttaccatttcatcttttctcccttgctctgtctctcccatcctctgtccctgcatcttatcccacacacacaatgccccccaatctcttaattcaaaaaaagggatgggaaacccaaggacacagttacagaaaagactggcagaggaaagaagacatgagcaggggacacagctcccagccatggattctttcataaagactctttttattttttattgaaaataaaaaggttgatgaatgaggactgggaggaggagtggtggttgaaagagggaggcatggttggagagtggctctaatggaggggaggacaggagcccaaaataggatgaggagctctgagacattgggggaattccctggggaggtgtctgggtgccttccctccctggagtgtgctgtagtctagggttcacccagctccctcacctgttgctgaggttcctggttttgtggcctatgaagtcttgatggctgctgctttggagatctctgggctctgtgtttctgaggtttctccttccaagccccctcacactccagctccttctgttcacaggattcataggcagcttgtacccctgggacaatgacaagctcctggatgtcaccctgcaaagacatgaggaaggaacttcaatggaaggaggcagaggggggttcagaaatagacagagggttaagtctggaacaagggctaccagcccgtcctaggtaaaacaacataatgggagaagatcattatcagccctcccatgtacatagcccttttcagttttcaaaggaccttctcatccatgatcccactggaccttcaccacaactgggaaaatcagtagggcaaggatatttatgcctattgtttgatatattccactcaggaaagcccaaagagacaatgactggcacaaggtcacttgcaatgatggactcagactagaaattcaaatattccaactctaaatccaacattgtttgcctatccccggccccttgtggtaatgcatgaaactttccacaaggcttctgaaaacagtgtcccagccttacttgcttggaccttccaatggcagaaatgatgagaattctcgggacctctagaaatgggggagagggaagccacttttgaattccaatgccatttatctgtgcccacatgtggtgcttagcacaccttgccatatattatagtttggagttactgtctcatcttcaaagaggacctgggagctcctgaggatgacagagatcttacagtattcttctgtgttccctcttgagactgggacagcaagtattcaaagaatattgactagcgaggtgggtggatggatggatggatgagggctcagatgcatgactgactgaatgggagggttagtggatggtgaatgaatgaatgagagggttggtgggtagataaatggaggtatggagtagagagaacagattgataggtaggtagatgggtggaagtgaatatgtgaatgaatgaatgaatgaatgaatgaatgaatagatggggagtgcgtgggtgaatgaggggacggatgaatacatgcatcctcatatgcatgggtagatgggctaggtgggtggatgaatgattgaataaatggatgggttaaaggtgaatagactgacggatgagtgaagaagaaagtggctgggcagaggaaaatgggcaaatgggtggatacaaacttgaatgcttgattggtgggtaagtgcataaatgggtgggtgggttttagatgagtacatgaatgggtgggtgtagatagagagattagttgaagggataaatggataggtggactgatgaagacagctgtcctgccatagaagtgggtgcctaattctcctacagagaaagttagccttgaggatagaaaatggaaatataaattcatgagagctcaaatgaagggccagagtataagaagatggagagctggggccagaaggggaatagacacaatatatgggataagaaatcactctgttctctgttctggttacctcaaacacttcttcatccaggatacgggcaccaaagataatcactccatgggtgtccaacaatggacgagcacttcgggggagaggccgggtgactcgcttcttgcagtcaactatgagagtgacagactggcccttcacagccacagccacacggtgccacctggtcatggggcgggggggggagtggttcaagtgactgagggggtgggctcaacagggccagagaacagttagttgatggagaggttggagccaaggataacgataataggaatcacagtagctactatttattgaatgtttacaatgcaccaggcaatacttttctcatttgattctcgtgatcctaccatccctattttatagccatagaaactgaggcttaaaaaagttaacttgcccaaggcacaggctagtaccacatgcaaggatctaaactctgaagtccaaaccctaaaccaacaatgtctgaactttgggcagtaggtagatgaggtgtggccaaaagggttggcagggtttcctagtgtagggactgggggttctggggcagtggccagaggggagctcccgaaggggcagtgcaggcagaccagaggagcaaactgacttacttgccatctgctaggctgaggcctcggaagactggctgagctgggggttgaggccgtccagtctggtcctcatacaggaagcggaagggtcggccaagctccaggcccagctgttgaacaccctgggcactgtagagtgtcaggaggggagcctgaaggccaggacgggtccggacagcagtcagcaatgagaaatctttgggaaaacctcctggtacccgaaagaaacacaaccaggtgcaatgagagtaaaaagagccataaaaccctcccctcctggtgtctgattctagaccccaccctgtgaccttgccccagctctctctattccaccatgtcacccatacctggaaagagctggcgggtgggtgcactgagctgggcaggtcgggacactcggtaggccacatcagccggacagatgcctctggccctccggacgccatcaggaagggagggaaacctcagggccctgagcacatccacagggggtacacctgggaaagtccatgagagtcaggaaaagggacacatcctcaggagggccaagacatggggacatttggagtctggaactgaacctcctagggctcaagctctctgaaggcaaaggtcacctctcccttaacttgcctctgaatgggctctgagtggatgggaatcgagagtcacctggaagagggtggcactagctgtgtattcagctccacatggccctctgcctcccagtgtgtctcgctcagtctctccctatctctgtctttcaacccatgaatcctctctactctccaccatccccccttctctctcactcttcctatctctggatctgtagatctctctctctccctgtgtcttctggtttcgtccacctctcttacactctgtgcttttctcttccctgtctttctccctctctcactccctctccatatctctgggtctctggcctccttcccgtatctccagcagaaacaacatctgggcaatcgatcatcctgggcataggaggtgcagaggggccaccaggcagagtggagaggcagatctatggggatggggcttcaagctgcttcagttcctgcatttggggagttggggacaactctgaccatgctgaggaaggagatagcagaaagagccaccccaggagcctatacccctggctcaggagatgggctgggggggcgggggcagaggggaggactgaagctgccacgaggagccggagcaggtccagggccccaagccacacatctgtggatcccatcagagtccttgcccaaaaccaggcaagctccccacacctggaacttcaaccctgcccccccccaaccaactcttggatccaaagattcaagacccagggtatctgccctatccacctagaattcagcttcctcaggctcaaactccctggaagacaaaggtcacctttccctctcttgttcctccatacacacactcctcacaccatcagctccagattggaaaaatcccagagaaagtccagcaaaattttcatagaagcacagggtgggcagggcaggggccagagcgatcagaagagtagggctgggtggggtgggtgaggtgcagcggagaggcagagaaaaggctctttgagtccaggagctgggaaaccacggccttgccctccccttcaccaccaccccgcctcgccctagcctggcccctgagtgtggcagctccacaaacaccaacacacaagggctgctttgagagaggaagggtgagtgagacagagacagagactcacagagaccccaggccaaagagacctcagagcccccgccccttcaccaaatcccacaggagtatggttccatcctatagacgatctacccacaggtctgcccacccatctgccaacctcaagccacatatgtgcccccactggctctggcctcaatctgtcccacaggctccccactggtagccccatctcccccatcagtctacctttgccccatttttttactcttatgaattccacagtagcccatttccctgtagagtcccatctctggccactcagccccaaaataagagaatcatctcagccatgcctagcctccatgctagagggttccttgttccttttctccctaagaaaggctccaagaatccacagacatcacgcgcttcaatttcctgtcccttagcctcatgctccttgcatcttggaagttcttcctcctgtgatctaatctaaatcctttatgctgctattctgaccattttctctccagaagagagaagaaatgaatagtggagttatacgcaaatcagctggaggcaaatcagttaggtcctgcctgcctaggacccaggcgctcccagccccctccgtccagcatcaaatcccttacctaggtcccaggacttctggatcctgagaaaaaagaaggaaaagattggggtgtggacaccggggtcccaggggagccctgctggccagagggggaggggtgaggcaggaatgcaaagagttggctcccgcctcagacacctgatcccagcctgtccagcggccgtcctgttggcagccagccccagtgctccccagagccagccgcgtggcagcatcgagggcacagggagggggaaggggatcctatcggggaagccagggggacaaatagtccaggcgtcccttctttccttacttactgctctgctctgacccacagatgctcctcccctctcaccccagacatagatagaaagcccagaagacacacacaatcctcacccgtcaacactgacatctgcctcctcaccccagcatcagctggacttcaccagccctggccatcttcggctctccctggagtccctcagcatccagtcccactctttaaggtgagcctccacctttcagccttacctgctctggcccagtcactgcaaggaggcaaagagatccctaccgtggttccaaggtgacctgccctccagcctggatccttggcccccaaaatccccttcttgaactgagaacctggcccccagcatcagctgtcccctacccaggggttactgagagctaccgcctgactctgaggatccagcgccgggactcctcttacctgcccaggcagggactacgctcagccccagcaccagcggtaccagcaggaagaggcgatggcagcggctgcaccgctccatggcttgcgaccctaacgccgggtcccagggacctagggccggccagaggcgctgtacggcccaaggctgacaggggagaaaagcaggctttgagcctcggacgctggggttccgtagagatcagaggctgtcgggtagcaacagctctcagtggcccagctccatgcaaccgggcgccgtcggggcttcagcactgctccctcctcggtggccgccgctcctgtgtgtccccggccacccctgcggcccagagcccccaccccgcccccgtcctggcccagcccccgcctccagccgcccgcccacaggcaccgaagggaaaccccaccctcgatctccacctggtttggggtggggggacaggagccctcgttccctgcccctcgtgctgctttcctctgctccttgcagactgaatggcctgtacccaagattacctttttgggaaccccaatatctcttccccggccccttccttttctaggacccagacctccagtcgaagcccccacctcaactccctcccacctggctgcccagagcctcttttcagcagtcctgggcgggacttaggacacagtgggaggggagaggcgggcctgggggggtctctctccccccccaatcaagtctccataattacttcccttcgccccgcccagtgtaattacaggggtggcctgggatggggtatttatagacaaggctatagatagcaatggggtacctgctacccgacagctgcgagtggtggggaggggggcaggtggttacaggaggggaagcgggggggagggtgcggcgtgggggcggtgagagccagacgctggacagcccaccacgcacaggataatcaggtccaaggagatgaagagggcggcgggacgaggccagggagtccgggagcccaggtggcaagggaccccgcggagagacgaggggccgtcgaagctagctggaagagcgcggggaacagggtcactcggggacgagacgccggtccgggcgggcaatgcctgagggggcctccgtgctccgcacccagcgcgcccccaccgacgggcacggcgccgggtctgcccggagcccgcagcgcggccggcgagggctggagctagccgaggcgccgccgcccgctggcgctaggagggcgcgggcgaacaaggcgcctttgagaatcagccgcccccctcttcctcctccggccggccccgcccccagcctggcacaccctctcccccctccccgacaaagcgcgccttgtgtcccccacccggtgtctgcctctcgggccccagggaacctcggcggcggcagcgtcaagggagcgcggccccggagctcccgactggataccctccctgccccccaccactcggcgggtgccccgatgcagtgctgctcccctcaacacagtcacctcagtccagaaaacagcgattttaatttgaaagctagtttatgtgtgagtgaaagagaagggaaaggaaccccagagaaaagagctgcagggcaaaaatcatgcagccccagcacctcatctccgcaggctaaccatcccccctcacttctcaggccagggtcctgtgctccccccaccccagtctacactgtgtgtgcccaggtctggggggaggctgtcaaaggaagggcctgaggactgctcaccaaaccatcccaggcccctccctctacttagacaagaagagatggggagggggttgggaaagccagggcttgaagggccccatggacagaccatctcagggcccagccttaacaaacaccacctccaccactggcatttcttagtcaatctgggaaagtacagtacttctttgagtctaactgcaagtctctatcctcagaggaaattaaaaatagcagatgggttcctacatctccacccacccctcaaccactactaccttttcatttttcagtctgactgcagcaggaggtgaagtgtgagacagactctggacaggagacagtgacaaggctcctccttctaccagagtagcccccacctgccgggctactgtcaaggctgtcaaggtctcaaggaaggcctgtcagagtgctactcccatgtccatcagtttgaggggcctgccccccaacatccatctctgggcgagttcccattttctctcttcacatgggtagctaagtgaggcaagatgagaaggaagcaaggtcctgtgagcaaggccagtgctttgtgctaggggaaggagagatcgttccaggcagggcgtgagaactcaccccaaatcatggcagacccacacaagttcagagactcaaggccactgaagggagaggtccagccctcacaaggatcgggggtcccctctgatttgggacatcacgcaaatcccctggaaggtttatggatccccttggaggtctcagttctgccctgtactcctcacctcaccaaggttctagggcatggcccctcccaccatgccccaagtctggagtccccctcatgtatactcctcaggtgtgaggagcaccacatttaggtctgggctcaggccagctggtggggagcctcaagcatctccatgaggaaggtgtcaataggggtgtctccaatgagcttgaagaaaaacagatgctctagacacttaaggccgatggacctgagggcaggaagacgtagcagcagcttggcaaacctgaggtagaggtgggaaaagacagctggaaccacatgggctctgatggcaccccacaattccttgcccccacagctccttctcaccgtccctgctgctcagggtacttctgcttgcaataggtctccagtgatgcatacactttctcccgcagaacctccacctcactagggttggaaaggcccttggcatctgggatggcaaggaaaagaggaggaagaagcagcaggacaaatcaagtcaggacaaatgtggagatgtggcccacacgataccctctttgggccccacctaaagcctctttaccagatgcctggcaaggaagcagggcaagttatggaatggggtcaaaagggaacgtatcagtggatgtgggtttttcctggtcagctgggaggtttccgggttgaggggggatagctgggtaatttaggagtctctggagaagaggaggctccaaggttgccttggtcttaaaagacaagggtaatcctcctcttacctggattgaacagaatgattgccctcaggcagccaagctctgtcttgtccatcctcatgtcacgcattttggacactagctctgtcagcaccctggagagggacctgcaggtcactcaaaggtcacagctcagccagccttggacacggaccagcctatagccccaccccctctacctacaggccagcccagcagcgggccactgaccgatcaaagatggctcccacgcctgcagaatgggctgagttgcggtgcacatgaagacctgtggcaaggaggatgccatctcggacatcaatggatcggtgggagaaggaagcaatgaggagctcgttccagcctgggtagggggcagcaagggtcaggagccagggatcagaccatgggagtcaaagcatatcaggggaagagaagaagtggtgaggtcaatgaacctggcccccttggtatgtaagtatccactggggtcactgaaggccagaaggtcaagtaggggtcaaatgtcaagaactcaaggggatgcaaggtcactgacctgcccgcagcaatatgacctggtcatccagaggcaaggaggaaaagtgtgggatcctcttcgcccactcaacaagcgtgaatagctgtttgtcagctgcctgacagatgttagtcacagggtcatttggctgcaggggatggggggggggtgcaagagttacagaaggtctggaaatacaatggaacccccccagttttaagaggtttctgatatcacctcctcatacagagtctcccttcaaaaccatgaaccaatccctgtaagtcaggcttctcctctggcatttgtgaaaacaattacgtatttaggacttgcctgtggttctgccactgggttgttttgggatggggacagaaaactatcacacccacctcagatgtttgacaaaccttgtttggcagcacttccagtcccaagcagtgttgtggggggaggtgggggtagggttgggagggaaagggagtggagagggaaatagaaccaacctagactcccatccccccaccccccatcaggaaagagactggattgaccccatcactcacgctgctgccactacccccggttcccccaggaccctcaacgccctggtcactcttctgctccacagcaagctctgcctccaggatcctgtccacaggcatctcctccggggctcccccagccccttccccatccccgtccttgtccttcccccgctgacgctcctcctgaactgctgcaagtgggaaggggaagagaagaaaaagtggaaagtcaacagtcagccacgaagggttctgaaatgtccttaggtctcatcagggttcttatggcccttaggagatatttacaggaactggggaagttactagcaacagtggactaggagcagtctggaaacgagttatacaagtgcagataaacaagccaagaaggaggaggggatgggagggtaaaggaattagggagaaagctaacatttaaactgaggcccaactacgttctaagaaatgtgaaaagaaatgtaaaatgtgaaacattttatagttccctcaaattattttaagaatcatgtgagctcttacccctgttgctaagatgaagaatttagggcttggagaagttagatagcttgcccaagttcacataatgcccggcaagtcatccatctaaatccaagtttgcctgactgccaaagagatgctcttctgattcagtgaagagatagtgaaaggatcaccagcctgggtcttcaaggatgggttctgatcccagccctgcccctcttttgttccatgacctcaggaaaaccaggcctcaagcccatttgactaagatactctaaagtgtttgaaaattccagcatcagacttaagacaagacaaagaaaagggaaggcagccctgaggtcttcaataaagtctgcaacttaaaagagtagagttccagactttggaggaaggaccacagataaacaatcatttgggtcaaagaggagggactattcaagctgagaagaggagacagagaagcccatcacaggtaaggaaaagctatcctaccctagtactggggggggggggggcaccccagtggggcaggccacagaaaagccccccccttaagaaggaaatgagaacagaacaggataccaggaagaagagctgatgaggaggggagagagaaatcaaatatcgccctctggaggaggagagagaacagtccagtcctacggagagatgtagactaaggtttcctgcagtctccctccacctcctccctcctctcccacagggtagccaaggaagcccggctgatgtggacccttaccctccctcttcatgccagtggccaggcacttctgatagcggcagtactgacagcggtttcgctggcgcttgtccacggtgcagtccttgttgtcccggcatgagtaggtcagatccttacggatggtgcgcttgaagaagcctttgcagccctcacagctgtaaaccccatagtgtttgcctaagaggagaggggaagagcaacaaggctgcatgtagatccctcaccattaagtctctcaccaacttcccctcagcaaacttcgtttaaatccactgtgtttgccaaatagagatggggaacccagaaatgagggatgatccagtcccactctcctcactgttcaaaccctgtaccagccctcccttttctctgaccatccccctcccacatctgagcttcaggtcccttaactatcatcaagcttccccccacccacttgctccaatgcaaccctgtgagcctgtggcaatcccacaggtgatggtaaatgtcagatgctctctttcttcctttttggtgatcacctgagcctcgtacctgagcttcggtccccgcagattgcacacagccttttgccagccccaggaccacctggagggggtggacagtgcaggccccggacccctaagactggtggcttcacatcttcaggggggccagacccacccccagggagcgacactgttgagttaatctgggatgggggaaatagggaagtcacagggagactcaatgggaaggagaatctctcaaaggtcatggaaatcatcccctaccacctaggcagggcctgcattgcacattacagagaacattatttacattgtagtctctgtgaagggccacccctggagcacaaccccaaagagattagacatacagttctccctgagactgtgtaatacaggagccctgaagggcatgtatctcaggacaacagatgggtcacaaagggcaaaaataactgatagatgagtgggacgtcagcatagggtcagcatagggacccttttatagggttgggaaggaagcatgcactgaaagatcagtcacctcaggaagggcaaggggtctcacaaggaccacaggcctgccaggattagaggactggaaggtcagtgggccatggggaagttcacacaaggatctggggtcacaaggaaaacaaggaaatgaaagtggagaggcagtcagtgagccatgacctctcacctggggactgctgacaggcccggagaatcctgggggagctggagggggcaaaccaggggaccccatggaagagctgatgactgggaagggggagcccagttgggggggtggcatcgggggtgggggtggggccccggagcctccaagggttggggctgatgaaggggggaggggtaacccagggggagaagggggaggagccccctgggaaaggggattcggggaggaactgtctgggcttcgggagtctgagggaagggtacatagaggcacagagacacacagacagaaagacaaaaagagaaaatgagtcttagatcatccaactggagactttaattctctctctaacccccactgcacccctccaccccacccatcctcgtgtccagaaacacccggttgtcaaacaacggtttaactcctaattgtggtgagaagagggggttgacaaaagacaggagagttcgggtgagaaagaattccaagcaatatacttggtcacccccagctaggcagatcttatgtgggtggggcagcacgtggggtggaacggacagcccctccattcccagcttgaagccggatcgtacaatggaaaggggcggaagagacccttcctcggacgcaggatctgccttcaaacgtccagagcccccaaactcgaggactcgtgtcccacgcacgggacctcaggactgcagggcctcaaacagccaaagccaggagggcggaagctccccctccccgccccgccccggggggggagggcgctagggccctccggagggaggggacgcgtgtttacaaacaaggaggcgggagcgccagggaaggagcgccaggggacgggggggaggggtcgcagataacgcggtcactggttcgcctgtccgtccgctaggacactcaccccgcccgctgtcgcccatcccgtcccgtccagcctcccccggctccggctccggggtttgttgttctccggctgctgccgccgccgccgccgctgcgggatccagccagggccgtcgccgccgccaccgggaggcgaccccacaatgcatttcttttcgcacccccaccggcccacactgccctgcggcatgccgctgggggaggaagggcgggcgagcggcccaagacatgattcttggctgagtgcaaggataccgaagaggtaccagggattcccagatattgaccgggggaccagacgagcacaaggaagccccagagaaaaagactctagcctgaaccgggtcgaattaagcacttcgctcggctctgtaccaaaatgacagcgacgatatggcagccatcttggtatagacgggaagtctccgcgctagttcccgccccctcgtctagttggaaacggaggaggcggtctcctcagccctgttagcgggcctcgcccagcctcccctcaaataacctccagacttgcgcatgcgcgccagagtagggcagcttggcggcctccagagtgcagccatattggtaaaggtattgggaccgaggggcgacggaatttcctgttctcgcgggagccagaggcaggactgccacgtccgagcaaaccgggaaaggagaggatcccgaagccggtgagaattccctgccttgccctactgtcctttccaggccttttccactagctagtgggtcatagagactagggcccagagagtccgtaaagtgaaggaagaagcctagagcgatgtcccgggggccctatatccgggagggggttggagataaagaaaccaagtcttgggagcaatgtgggtgggcatagagcggaatgggggagcgtcccatagaagtggacggagggcacgaatgaagtaaagctgaccccgcataggtatagagttgagggtcaagtggagtcactgtctctgtcccctctggtcagcgtgatggccagaggcctgggggccccccactgggtggccgtgggactgctgacgtgggcggccctggggctgctagtggccggacacgggggtcatggcgacctgcacgaggacctgcacgaggacttccatggccacagccacaggcgctcacatgaggatttccaccatggacacagttatgcccatggccatggccacacgcacgagagcatctggcatgggcatacccacggtcacgaacatggacatgcacatgaggatttgcaccatggccatagccatggccaatcacatgagagcctctaccacagaggacatggacatgaccatgagcatagccatggaggctatggggagtctggggctccgggcatcaagcaggacctggacactgtcactctctgggcctatgtgagtccccaagggataggggagagaggggctggttctggattgttgggaatctccacaccacttgacccctgactttcccctcaccaggcactgggggccacagttctgatctctgcagctccattttttgtcctcttccttatccctgtggaatcaaactctccccggcaccgctctctgctccagatcttgctgagttttgcttcgggtgggctcctaggagatgcctttctgcacctcatccctcatgccctgggtaagtgatccttggcaactactgcaaatcttaatgtattttattctttaggcaaaaggcttctttcatctttgtcacccctgactttgcagtattcccccaaatgcacgctacttgggcaggctattccctcatttggccttttctccccctttctctagaacctcattcacaccaccctctggagcagcctggacatggacattcccacagtggtgaggaaggggtggatgaagatgtgttggaatgttgccgaatgggaccatgtttccctcccagaatggggccatgtttccctccctattctcttgcacttggggaagaagagtctggagtccacatctcccttaatgtctcaatgcctctgtttccaggccagggccctattctgtctgtgggactttgggtcctcagtggaattgttgcctttctggtggtggagaaatttgtgagacatgtgaaaggaggacatggacacagtcatggacatggacacactcatggtcatacacaaggaagtcatgggcatggaacacagagtaagtctaggaagaactttccttgaaaaacaccttagctgcaaaaaggaagagacttcctttttggggatatttttggagatctctgttctccactcttaaacaacttcttccctcagagtatccttcaaaggagaaacagagctcagaggaagaagaaaaggaagcaaatgggtctcggaagaggaaaggagggagcacgaggctcaaagatgggccactgagacctcagaattctgaagaagaaaaaacaggttcaggtgagagccagggttattgataaacttgggtaaagtgtatcatgttttacttggagtatgcactgtggataatggcagctgtctggaaaacatgaaggggctggtgtgaagtggtctcttggggggaagaggtaataatggctgataagggctagaactaggggtgttagatgcctctaatcattttgtctttctttccacttttacaagacctacgtgtatcagggtacctgaatctggctgctgacctggcacacaacttcacagatggtctggccattggtgcttcatttagaggaggtcgggggctagggatcctgaccacaatgactgtcctgctacacgaagtgccccatgaagtgggggatttcgccatcctggtccaatctgggtgcagcaaaaagcaggttggtgatgatgtgcatcagacatgattgcctcgaactctacctcctactcacccatccaaaactcagaattgcctctcagtagttccaaacaagttgtactgttaagaacaacaaattctccagaaatgagggcagagaaattctgtttctttgtcctttggctgagtatttcttgaactatgctccacactccatctgaatactttgagggtctttcacactgctctcgaccctgacctactcaatcagaaggtctggaaaggatctccttggtattttaagattttacggaaagtgtctattctagatccttctctttttgccttcctttttagttcccagagacatccaccttgtccatatatacctataccctaccagccatgcctaaccactgatcatatttagatgttgttgagtgtcttctgtttttttctgcccaccaggcgatgcgtctgcaactactgacggcgataggggcactggcaggcacagcctgtgccctcctaactgaaggaggggcagtgggaagtgaagttgcgggtggcacaggttctggttgggttctgccattcactgcaggtggctttatctacgtagcaacggtgtctgtgttgcctgagctgttgagggaggcatcaccattgcagtcacttctggaggtgctggggctgttgggaggagttgtcatgatggtgctgattgcccacctcgagtgagaggtggggtaaaccacccccgccccaatcccaaacctctagcctctctaagccctccaggtcaggggtctgtggagtttgggggccctggccagggacatctgccgaaggaagttgtatcgtagggaagtgttaactttggcatttgggccatcaagattttgcagtcttaaaggagctgcagaagtgagagtgaaaagtcagaacgaccatagtgttagtaatgtgctgaccatcttgggtttgaggctaattgaggccatgaagacggctggaaaagagaggggggtgttgacagcctactcggtgtaccctacgcaacctgttttagaggaccaagccaaccacacaggtttctccgaggtccgcctccccctctcacctgttggtggaagcttcagggaagatcagagccctggaaagaggcagtagcaggaggagtcagggatatacatcaattgaacatcaatcgtgtgtcctgatttgggagtgattgagggaggaggtgggttgctaatctcatggcctgatttttttttttttttctattgatatcactgttagaatcgaggggtaggggtggtgaccggaaataaagtcctcggatcttccgccccacatgcggtctttgtcttttttgggagaatgggggcccctcatctcgcgactgcccaggcccccaagtggtggtgtctggccacgcccccgcggtgggaggtcggcctgcgctggtggccgcagatggccccgcgctggtcgcgcctagattggcgcggctgcgccctggccacgccccctggctgggattggctgagtgctgggtgtccgcccgcccgcccgcctgacatggcgtctccgctcaggctccgctccgcgctggccctggtcacaggttgaggggatgctacccccgggcgggttggggtgccggagtgttgtcggggtcatgccctcggcgcctgcagcttctgtgacctctggcccctggtccagattttcctaattttgcgccctgttgacctgtgacccctgcccactcgtccctttctccccctccgcgtgttgtctcccacttcaggcgcgggtagcggcatcggcagggccgtcagtgtacgcctggccaaagagggggccactgtggccgcttgcgacttggaccgggcggcggcttgcgagacggtgtggctgctgggcgggcaggggagcgagaaggtggcgcccggcggggcccacaccgccttccaggctgacgtgtctgaggccggggcggtcaggcgcctgctggaacaagtacaggtgaacgcgacacgacctcgccctctttaacgagctggcatggcctccactgcccgggcttgggttttgggttttggtgtgtaaccgcccccttccacaggcctgcttttctcgcccgccatctgtcgtcgtctcctgtgcaggcctcaccagggatgagtttctgctccgcatgtctgaggatgactgggacagagtcatagctgtcaacctcaaggtggcgacctctgtatctgttacttcttgctccaccagccgggagaagactgtcaccccagctgatcccttctgttttgttactctttcctcaccagggcatctttctagtcactcaggctgcagcccaagccctggtgtccagtggttgccgtgggtccatcatcaacatcagtagcatcgtagggaaggtcaggttgagctgggatgaggtcagtcagctagttgggcatagagaggagaacccgtccttgggactcctgactcatcccaaatctctgacttacctataggtagggaacgtgggacagacaaactatgcagcatccaaggctggagtgattggcctgacccagactgcagctcgggagcttggacggttggtcagacacccctgggggtacagagggatttgctgaggtatgtgggaggtctgggggccaggtcagtgctcagtcctttccagagtcagcagccaatctcctttccacagacacgggatccgctgtaactctgtcctcccagggttcattacaacacccatgacacagaaagtgccacagaaagtgctggacaaggtaggaggctgtgggtagagggcagaggacagaatcattcagatactcagtctctctgggcttcagagagaatctgggcacagggccaggcgaataatagatattcaataagtgtacaaggaatgaagacaaaagaaaaaagagtcacaaacttaaccaccaacaacaaaattccataaaagaaactttcagtcacttaggagtattttcttacaggtgattggaatgattccgatgggacatttgggggatcctgagggtgagcactgaacgaggaggaggccctagggagggggtccaaatgaagaaataccaaagtttgtggtatctgagaggatttcactaggattggtggttggagtgtgtgtgttggtggggaagggttctggtgggaggtgatcactttggatctatgagagtgagtaggattccatctcccccccacccccaccattcccatagatgtcgcagatgcggtcacattcttggcgtctgaagacagtggatacatcacaggcgcctcagtggaagtcactggtatgaggccatcgtggggagggagagggtagagaagtggaacccagatgataagagaaagcagatgaagggagtctggagccactgagggaagagcagaagttcccataggcgagggaccacagtgggtgcccccagcccatttgtctccacctatgcatctgtccaaatgtttctgcccctgccaggaggtcttttcatgtaactgcctcacggaccctggactctgctcactcccccaccactccaaccggcctcctgctgatgaggactctgagttcccaggctacaaaaggcgcagcagtgtatggctctggaatgctgaatatgggaggcaggggtgcttgtgaccctaataaattccaaatcctcttccctgccacctccggttcttcttgtgtctaagccctcagaccctttcccacctccccctcctttgcctttcccaaaggattgttccctttcactgcctggtctcccagggcaacccccgccgccgggtgtgagaggagagagtgtgtgtcactgtgtatgtgtgacattatgggttttttttttagaggggggggtctctgccccacccctttccactagtcatgcagcctcagtcccctccccccaattccctgggtccttatggtccccaagggtggtttgttggtggccccatcccagtgtccagtatggccttgggagggggtcttggaacaggtggccctcccccaccggtctcccttctctcagtaccccctcccctttctctccaccttacaatagctgcagccggcctggggtcgggtgggggggattaggggagggggccaggattaggggaatggaccagccgaagaaaggggctggaggagagcagaagggagggggctgggaggaggaggaggaaggggagggggtccgagctaatcgactctggagcccacataaggactggccacggactgaaggagaggacagggaagtaggggggaactgggggagggggagaggggacccactgctgccttgtcccagaaacaggctaccccctggcagctgcagcccaagtccgggaaccccagcttaggctagaggagacaggacgcccaccgcggcctctttccccttggtatctcatcccctgccctcaatggggatcgctctgccccttcctcttctctctcctccccgaccccttcctttactgcaaagtcccggaggaggcttctgcccgcttcccactccagacattctgccccttgtgcccctacccacccacacgcgcacaccccccccggaggggccccatcttgtgtgtgtgtccctgcttccgcgtggtgtctccattcccccgttcctcccgtgcgcctccctcccccgccccgggccgcggctcttgattgtccaaacgcaattctcgagtctctggctctggccgagagttgagtctggacgtcccgagccgccgcccccaaacctcgaggggagagcgggtcggagggtctagggagagcccaagcggagggtggaccaagtccccagggtggtgaggggaatcccgggcattcaccggacgggaggaccgaagcggcaggggatcctttgcagccgccccacctccgctccccggaatgccgggctgcggtgacggagaagttgtggggaggaggacagctgctccccggagccgctaggggacgaggagtgggggatgtggccccttttcccaccccctcggtcccctcccggggtcctagagatcccaggccccgccctccggagcggaggccccgggtggggacctcgggcggggaacggcggccaaggtgggcagcgcgacggtgcgggcctggggactgagactgcggcccccacgtagctcgggactccggggacgccggctctcccgcgcagcaggcgcgtcccgagggcggggtaccccggcgcccacgtcgcgtcccccccccacccccagccccgagcggcgggtgacgtctccgccggcgggggtggggggtgtagcggagggacaggcggaagtgacgtaggccccagcgcccgggccatggcggcggcggcggcgggagctgctgtctgagcagcggctgcggaccgagcggactggggccgggagcccgggccgggagagaggcgctgcggcagcggggcgcggacggctggagcccggtgaggggcggcgcggcggggcggaggggcggggggagccccggaggggcggggtctgcgcgacggcggcccccctaacaccccttccctctacccccgctccccagcctacctctcctcctcctccgccgcagcggagccccggtgggggtctgtgcccggtcaccatgacgacgccggcgaatgcccagaatgccagcaaaacgtgggaactgagtctgtacgagctccaccggaccccgcaggtgacaaggactctccctccacagctcactccctttcccagacccttccatccacacaccccatctcacggcctcttttccattttttttgccctattctgccgaccctgcccgatgtcacagactcccttggccctacctttgaatcaccttaatctttacgagcacttcacatttatctagtttaatcctcacatcagctagtcccacggatttaccgcaagtatgactgccttcatctgaaaggtagtaaacaaaaattaccttcactgttcctcagctcaatgtcacaagtcagcgcacagaagactctccttccaattttagtaaaaatagagcctctcggccttcccccacctcccagcattctgatacaatagagatggggccctggaatctgcgttttaaacaagtcccctgggggattttaatatagcttgaacctggaccatgctataagaaatcctattgaaaaagtcctccccaaactccaagtctgtgccaccacaagccccagacctctcgccaaacctcagatcctcctgtttcgaagctcctacttttagttaatggacactaatcctttcttttttcattctctcccaagtcaaagctcctctcagaattaccatcttccctagcaggccaacatggggtactcagattctgctatttcactgtacttctcaaaattcccatttcatggaccattttttctaaatcctctaccccccccccaacccaccatcacatttccactcactgatgcctccaggaagccatcatggatggcacagagatcgcggtttcccctcggtcactgcattcagaactcatgtgccccatctgcctggacatgctgaagaataccatgaccaccaaggagtgcctccatcgattctgctctgactgtattgtcacagccctgcggagcgggtaacaggagggatgtgtttgagatggggtgaagggtacagacttggaacctcattgccctggtgactgactgttcagagcctcctctctcctaccccaggaacaaggagtgccccacctgccgcaagaagctggtatccaagcggtctctgcggccagaccccaactttgatgccctgatctctaagatctatcccagccgggaggagtacgaggcccatcaagaccgggtgctcatccgcctcagtcgtctgcacaaccagcaggcactgagctccagcattgaggaggggctgcgcatgcaggccatgcacaggttcgagctgggggagaggctgtagcagggctggtgggacagatgcgtgggtcaaacacctggtgctgtctctgccacctgccagcctctaagccttagcatcctaatagctagccacaccctgattgtcaaagcctggaagtcagggatgtaaattgaagcttcttagttagcaaccagcactactattcttaaggagaaattatctcaccctctaactttctagaagttagaacagtggagtgactttgagcataagctctgggaattaaatgacctccgaggccagcattgttcagtctttaatgtgaatccagattacctgaaggtcttgttaaaaatgcaaattctaattcagtaggtctggagttgaccctgaaattctgcatttctacaaatctatgctactttttctgggaattcatgaggagcggcaaggggctgtgatcgaaccaagttagttctaagcctctaagcctcagtttcctcaaccataaatagaataataatcacctgcttctaggatttgtactatgtgaggcaataagtgcaaaatacttcgcagcgtgcttggcatgtagttagtgtttaataaatgttgggtgtcatccgtaagatgtccctgatctcttgttctctcctaagtttaaagtctaaaccccttatccttggcgctttctaacctcaaccacttctttctacagggcccagcgtgtgaggcggccgatgcccgggtcagatcagaccaccacgatgagtgggggggaaggagagcctggggagggagagggggatggagaggatgtgagctcagactccgcccctgactctgccccaggccctgctcccaagcgaccccgtggcgggggcgcgggcgggagcagtgtagggacggggggaggcggcgctggtggggtgggtgggggcgccggttctgaagactctggcgaccgaggagggaccttgggagggggaaccctaggccccccgagccctcccggggcccccagccccccggagccaggtggagaaattgagctcgtgttccggccccaccccctgctcgtggagaagggagaatactgccagactaggtgagagccctgtcttcccgaccgctgagaaaccagacagcgcctagccttccatcggaagggggcttcacccaaatccagcaacgacccctagctcagaggccctgctggaaagcccctgcttcccttgtccatttaaagatttctgtggcctaaacctgccctctttcccacttcaggtatgtgaagacaaccgggaatgccacagtggaccatctttccaagtacttggccctgcgtattgcccttgagcggaggcagcagcaagaggccggggagccaggagggcctggagggggcgcctctgatgccgggggacctgatgggggtggcggggagggtgggggtaccagaggcggtgacggccctgaggagcctgccttgcccagtctggaaggtgtcagtgaaaagcagtacaccatctacatcgcccctgggggcggagctttcacggtgagagcctctgagagcggtgctataagaggagagaggcggggagggtggcctggggccacacggaaccatagattctgacttctaactggcccaccctcccctctccctctgcatcgcccatctctgtcttttcttctccccccatcactccctgtgccccggctttgccccatctcttgctcctgcttttttctttcttcctcccttgatcattttctgccttattcatatcctttatcaccttctccaactttcttttttcttaccttgcctctctctcccaacccctctgtagacactgaatggctcgctgaccctggaactggtgaatgagaagttctggaaggtgtcccggccactggagctctgctatgcccccaccaaggatccaaagtgaccccacaaagggacagccagaggatggggaccatgggatgtccctttgtcctggcctaccacccccagcttctttgtcccccagggtcccccaacctggccagccagcaagaggacacaaatgaggacaagtggcttttatacaaagtatctatatcagattcttctatattgtacagaacggggcatgcgcccccatctactgccttttctattgcccccccaacctcccagctatctaagatgttggggaaggtgaagaaccctccccttcatgccctcctaccaacaacaacaagtttgcttcttttcctctttgaaacctgcagttctgtgtctctgttcatcagggatgtactagaaggggaaaaacaaaaaaaagtgggggagacaagcctggaaatcatgtggaatcagcctgggaaatggggaggaaatgtcaaaggttattcacggtgtgtaaatcccaattttatgaatcccaagtcagcatatatgtatgaaaatagtggggaacaatccatgaagctggaagagacaggatggagagccgagcggtgtctgaagtcagatctcaaacctgccccctaaaacctgaatcgccctgcctgaaatccggggtttcaatatcaaagggaaaataggagagtggctcaagacagcaaggcatgcttgtagacgccaacgggacctgcagttccgaagcctaattcctcaccgctgcgagaagctggagagacgcggggagcgccgccgaacctccctgctgggcatcctggccgccccacgaaggcgggcagggccggggactacagctcccaggagcgcgcgagaggagagggtgcccgccgcgccgcgccgcgcggttctgctgctgtcccggcggcggccgagagccgaggggtgggggcctccggggaggccgtcgcctcgaggcgcgcggcggggtccgggggacaggggagctcggctgcacgcggggtcccgggcagtgcgggggtcggggaggctgatgctccctctacccccttcagcccctctgcccatcacttcctgtttccgtcgcccttcgtgcccccaccccgatccgcctcaaattcctgcggcttctcagttctctgccccgctggcagaggagtcagcctcggtgcgacccacagacccgagggcgccccaccccacgcttggggtttcctggttttcccctggtccctaggaccttcagaaccgaccgggcatctcccgcccgcgcaggtcccgcagccctggcggcccggagctcacccccgcggccctctggccctgcagacaaggacacgcgcttcacccttgcaggagcccctccctataccctcgcccgggagggacccttgaccccggctccctcctccccaagcccagcgttcccgggacggtggggcgcgggagggaggtgggcgtcgctcccggagtttcggagagaaacagccgcggaggagtcgggaaggataccgaggcggaggatggagagtagggaacgagcccggcttctcctctggctccagggactgctgggagtcaccccctcactttcctcattctctccaggcctgacggacccgcggcctcttctgcctccgttcccgccctcccctgagtcctggaacagcccgcggcccctcgtccctgtcccggccctcgatccctcctcggaccccacacaacagcaccccgccctccgcttctctccacttctcacatttctgccgcttgtcccttctctgcagcccccaggactgcacttcgaagatgcgcctgtttatttccgtgacatcatgtgggagacagcccaaactgttgccctaggtgtctccctcacccacgcaggaaggagaagtaactaccctccttaagcaggtgttctccttccctagtgccgggagaaggaactgttggggtgggggggagcagcagctcagattctcttgcaccctgagcttccctgggttagtttccccaaatcattcatgtctcatgtcagttatgcccgcatatataggcgaggcaaagccagaaatacaaagtacacaaaaagaactggactattttgttgaggacctagatacatgcaggagaataacgttgcaaaggagcaaggtagagaaagagaggtcactggaggcagggtgggattaaatctccaccctgccagcatgaaactcggggtggggggacattataacaacccctcccggggattctgatgtgcaccaaggcagagagaagcagtagagcagatgctccatgacatgttagctctgtccttaaagggtgaacgcaagtgccccacacagaaggggctccacacctgtggagcagggggatcgctgggaacccttggggtggctgggaagggcctcacagaggaggtgggatccagccaggatccaagtgaagggaagaagagagtctggagggggtggggagcctctctctcccttactcttccataatcccacctcttccctcgcccgggcttctcagtccccaaaccatagcagatcatgtgtctggacgtggcagtgagagcactgtgtgagacgacacacgtgagacatctcagaaaaacttaggaccgcctcggctacaaatgtcgccagggagacggctcatcccttcttctgttttctccccacccccaccccatgttgtcacgctccaaaactagcactagcacttcctgccctgctatttgtacttcttctacaaaattgtttgctcactgtcctcttctcatgctgggcaactgattttggccagtcagcaggaagtcccacagaagtgtccctccagatggtgcccctggccccagcctggtgccggggaggatgctattaccattcacccttgtagaaggttctgttggaggagttactcccttgggcaacactcgcagtgacattattgttactattcatgttaaaagataaggtagatctgagttcttgcattaactgcccctaagtatactctttagaatttggaaaatttctccctactgaggcatccaagaggctgattactgactcgtgcaaggactgaaagaactttagaggtaaaaggatcacctgggagacgactagtcagtttcaccttttcaggaagttctactgatgccaccacctaaagggggctgttctgggacctggggattacaaacaggtgtctgattggcccctgccctggagggatgggatgtagaggtgttcgtagtgagcatctcagtactgaatccacctgcactccgatcagttgtatccactatactatctctcaagtctgttccccttctccgtccctccacttccctggtcccgccaccagctgaaacatctggctctcctgaatccccgcggtagtgagagagcctgggaatggccatctctaacgcgtgccgcacacctgagttagaggcctttttgaaatgcaaatctgattgttttaggctctctgcttaaccccagccagcggcttcccattgatcttaggttaaagacccaagtccttaccctggcccctaaggccctgtcaggtgtagctctgctggtctctccagattcttctcccgtcactctcaccctctgtgtgagggtccacttcctgtctgcccagtgcttcctcctgcagagagcattcatgcaggctgggctctcagcctgagagcctctttctcccatttctcttttagctagctcctcttcattcttcagatctcagcgtctctgccacatcctcaggaaaggtatcctgcccttccttcctggatcagattcccctcttctgagctcccacaccaaggggcaccttccctccgaggcacttggcgcgactgcagttctgtatttgttcattatttgatggaggcctcttttccccagaggatgtaagctccctgagggcagggattgtggctgcagatgctcactcttgtcatacaggggggaccctgaactggacactccaaaaatattgagtcgaaatattggtttaatggaggcatgggtgccaggatccggagtagagggccaaatattccaggatctcagagacgatggtttgaggccatgattttccttccctccagcagctgcagcccaggagttccatatgccattttctttcgtctttctttcttctttcttctttctttctttctttctttctttctttctttctttctttctttctttctttctttcttctttctttctctttctttctttctttctttctttctttctttctttcttttatgacatcttattttgttttttaaaaaaaagattttagggacgactcggtggctcagtggttgagcatctgccttgggctcagggtgtgatcctgggatcttgtgatcgagtcacacattgggcttctcatgggaagcctgcttctccctctgcctgtgtctctgcctctctctgtaggtctctcataaataaataaacaaaatcttttaaaaaatctaaacacaccatcacctggaaatactggataaaatatggggaaaggtaagcaagactgagttctcaaaaggaaactaaaatcccaagtgctagacaaagagaaaactgaaagccagagaataagcggatcatggcaatggttgctagaaggggactgggagagaattggttctattaaccaaaaagtgttttaactagccaccaaaggatgagagatgaggtcttggttctttttttttttaagattttatttattcattcatgagagagagagagagagagagaggcagagacacaggcagaggagaagcaggctccatgcagggagcctgatgtggactcgattccgggtctccaggatcacaccgaaggtggtgctaaactgctgagccacccaggctgcccgaggtcttggttctgacgaggtgtagaaatcagatgacaagtgatcaaagttgtctcaagaactagaaaacctgagcagatctataaattctaacaaattgaatgagaggttaaaacacacacatgcccccatctagatggttttatggatgtattatcctgccaactcttttttttttaagatttttatgtatttattcatgagagacacagtcagagggagaagcaggcttcctgcagggagccggatgtgggactcgatcccaagaccccaagatcaccactgagccacccaggcatctctatttcttttcttttttttttctttttttttttttttaaataagctctatacctaatgtgaggcttgaactcacgacctcaagatcaagtcacatattccacagactgagccagccaggggtccctatcttgccaactcttaagaaccatttgtttatctacttatacaaactgtcacagacaatggaaaaaagggacaatagcacttataagactaaaatcctaaataagatattagcaaactgaatgtggtggagtttgtgcaagtctgtgtgtgtgtgagagagagtgtgtgtgtgtatgcttgaccaagcagactttactgcaggaatgcaaggatggtgtactttaaaaatctattaatgatatttatattttttcatactaaagggaaaatatgattgtctcagtaggtgcagagaacatactgggtaatgtttaacacgaattcatttttcttaaatctacctaagattcgaaaataacttccaaagtcaagtatactagtttttactatttctttttttaatttaaattcaattaattaacatatagtgtattattagtttcagaggtagtgttcagtgattcatcagttgtatatcaaaacacttaattctttttaaaaagttttattaatttaagtaatctttacatagacccaacatggggcttgaactcatgactctgaggtcaatagtcacttgcttttctgactgagccagccagatgcctccctagtttttactgtttctattcaacttgtgctagcgggtgtgaaatggagcaataagaaaaagaagaatcaggaggatccccgggtggttcagcggtttagcgcctgccttcggcccaggacgtgatcctggagtcctgggatcgagtgtctggatcaagtccctggatcgagtcccgcctggttctccctcactctgcctgtgtctctccctgtgtctctgcttctctctctctctctcatgaataaataaaacctttaaaaaaaaagaaaaagaagaatcaaagtcgtcattatacatagataattaattaatgacaaaatttacgagaagccacaaacaattagaactaatatatccctttccagggacaagataatatgcaaacatcaatttgtccataccacaccaataaacaaatagaagattctgtcttaagaaaatgccgtttataatagcaacaaggactatagaatactgagaagtaaatatgacaaaatatgtgcatgatctttatggagaaaattataaaaccttattggagaacattttgaaaagaagacaaaaaagaatggagggatattctatgctcaagaagaggaaaattcaatataaagctggtaatttaaaaaaaaaaataaagctggtaatttgtctcaaatctataaatgtcagttcaattctaattgaaaccacaacaatatatttcatggcacttgacaaactgttcttaaaattcttataaagaagtaaatggccaagaaaagccaacatgagtttgaagcagaagaatactagaggggctactcatgccgtatatcatatatcacaactttgctatagaaagccagagtgatcaaagcatgtagtcctggcacatgggcaagtacataaactactgttacagagtagaacttcttgactcagaccttcaaagatatgagaacttggtatatgacaaaagtgacataaatcagtggaaaaagatggactgtctgttagattatcttgggtcaggatccctgggtggcgcagcggttttggcgcctgcctttggcccacggcgcgatcgtggagacccgggatcaaatcccacgtcaggctcccggtgcatggagcctgcttctccctctgcctgtgtctctgcctctctctctctctgtgtgtgtgtgtgtgactatcataaataaataaaaattttaaaaaagattatcttgggttaattgactatgcaaatagaaaaaaaaaaaaacgacaacaacagatccctacattacaacatacaccaaaattcagatagcttaaatatgtgaaaaacaaaattttaaactgcttgaagaaactctaagacaatatattgatggtatcagagtagggaaggatttcttaagatacaaagaacagaagaaataaaaggaaatatagacacatatgactctatctttattttttttaacttttacaagataagagacatcacaacaaaataaaaatacaagcaagccacagacttggagaatatttacaacctaaaagattaatgaagatttggtatccaagatgtataaagaactcttgcagctcactaggaaaaggacaaggcagtagaaaatgagcaaaagctacataccggcaagtcaccaaaaaaggaaacccaaatgatcaataaatacatgaaaagatgcttaacttcattagtaatgaacaaatgagaatcaaaaccatgagacagtattttacacatactaattcagcaaaattaaaatctctctgataggggcgcctggctgactcagtccatggagcttgcaactcttgatcacagggttatgagttcgagccccaggatgagtgtagagattacttaaaaataatatctctgaaaaaacaaaataactccgaaaacgccaagaattgaccaaaatgtgggacaattagaaactcccacattttgggttgaaatgtagacagctacgagacatttgaagagaaatgtggctataaatatagttgacccttgaacaacacagcggttagggttgctgacccaccacacagcggaagacccacatacaacttctgattccccaaaatttaacctctactaataatagcctactgttgactagaaaccttaccaataacataaacagttgattaatgcatattttgtacaatctttcttacagtaaagtaagccagaaaaaagaaaatgttattaagaaaatcataatgaagagaagatgtatttacagtatataatgtaaaaaaatctgcatgtaactggacccacacagttaaaatccacgttgttcaagagtcaacatacttaacgctaaaaatacacatatcctaatacccagcaaccttgctttgatatgtgttccccagaaaagtatttctacacgtgcacaaaaaggcaagaatcagaataggcacagcaggatgatttcactgtcaagaaaagtgagcggaggtatccctgggtggcgcagtggtttggcgcctgcctttgtccccgggcgcgatcctggagacccgggatcgaatcccacgtcgggctcccggtgcatggagcctgcttctccctctgcctgtgtctctccctctctctttctctctctctctctctctctctctctctgtgactatcataaataaataaatatttaaaaaaaagagaaaagtgagtggagggcagtcccggtggtacagcggtttggcgctgcctgcagcccagggcgtcatcctggagaccctggattgagtcccacgtcgggctctctacgtggagcctgcttctccctctgcctgtgtctctgcctctgtgtgtgtgcgtttctctctgatgaatacatgaataaaatattaaaaaacaacaaacaaaaaaaaaaaaccaagactctgatgcctgatgctacgtaggtggagagagctggcatccctacctattcttatctcctcttattccacatgaggtctcactcctatttatgcctggtaatcttaggcaagttgcgtcattgctacatgcctcagtttcctcatctataagatgcacatgttaaaagtgcctgtctcctagctttgctgtgagatttaagtaggttaatagagcttggaacagttcctagcttagagtaactacactagaaggtggttgttgctgttgatgatgatattagtgttcttggggatcaccttcagctgcatataaattcttttttaaaaaaagatttatttatttatttgagagtgtactcatgcaagcagtgagggggggtagagttggggagcagcgggagaaggagagagaggcagagaagcagaccctttgctgagtgcagagcccgatgtgaggctccatcccaggatcccaacatcatgacttgagctgagaccaagagttggaggattcactgactgcccatgtgtaaattattttttaatctcaggttttatttatttttaaatattttatttatttatagagacacagagtgagaggcagagacacgagcagagacatgggcagagggagaagcaggctccaagcctgacatgggactcgatccagggtctccaggatgatgccctgggctgccggcggcgctaaaccgctgcgccacctgggctgccctaatctcaggttttaaaatctcttaagaaccttatattgcaatgaaagtgcccgctatctgagatgccccagactctgccttcaaggagctacattaaggcctgaaaactcccatctctgtgaaagccaggcaggtaatgtgccaagtgcaaggttgtccagagaggcaacagctcgtggttcggtgttgccttgtaggaattcagagctagcattgccacatttaaaactttttttttttttgcaatactataagtcccaatttttctgtaaaatttctccattttgaagtgttgcagttaattcaaaagaatcataaaagcacattgtgaaccagatgaaatatttgagtgggttgccagtttctgggctctgagacggaggctaccacagagatagatgtaggagcaggtcttaaaaatacagtgtaattagggagatccctggatggctcagtggtttagcgcctgcctttgacccagggcatgatcctggggtcccgggatggagtcccgcatcaggctcctgacgtggagcctgcttctccctcctcctgtgtctctgcctctctctctctctctatcgtaaataaataaaaaataaatctttaaaaaatacagtgtaattaaagctacataaaggcaagtgacgagtgcactcagagcatgggggattgaagatggcagcagattctttgtcactctttccattaagatgtacagtctatcttcccttctcttgagtccaggctggccctgtgacctgttttgacctacagaatgtggcaggagtgaatgtgtaacttctgagattgggtcttatgaggtctgcagcttccacttttgccacctggaacattctccttggaaccaacccagtcaccatgctgagaggagcctgagcagccaccgagagacccatatgaattagacctaaggcccccagatgccagcagtggctgagctgcagctggcagccagtatcaactacttgccaagtgatgaggctgctttggaacatgcaaccaccccagggccctggccaacacttagtgaagcagaattgcccaggcaacctgcagaattgtgagaaacaatacacttctgttaaaacactaatatttagggtggcttgcagaacagggatagataaccaaaacaaggcagcattagaaaaaaggtgtcactttacctagaagagtcagagatgggttcatagcacttgagttttgagctaatccttgaaaaagacatacattggccctttgtgcggagggggagtggatcaaaagtagtgaactttccagaaggaggaaaaagcatgcctacagcatggacaacgaaaagcatgacatactctgtgattcccaattaagtcagttttgctgattggaacataaagtgcaaggactggggtgggggaggcgggcaggcagggaacaatcacaaacatttcttgagcacttactacctgccaggctcagtgacacacacttcacagaatcataaatcatgagtcctgggatgcctgggtggctcagcggttgagcgcctgcctttggcttagggtgtgattccaggatctgggatcgagtcccacattgggctccttgtggggagcctgcttcttgctctgcctgtgtctctgactctctctctctctctctctctctgtcgttcatgaataaataaataaaatctttttaaaaataaataaatcattaatcctcacaacatccctatctccattttacacatgaggttgcggtccagactaacttatcaaagatcacagagcctagaaatggcagagcgaggtttaaagccgctcgtaaaaagtgtgctcttcccaccatacttcatatagtaagtcagatcctgaaggtcctggtgtgccaggtgaacaagtggggattttacctgaaggggagacacagccattaaggaactgtgagtaagtgagaggctctggctttcactttagaagcatctctctagggcagcccaggtggctcagtgatttagtgccaccttcagcccagggcatgatcctggagactagggatcgagtcacatgtcacacgtcaggctccctgcatagagcctgcttctccctctgcctgtgtctctgcctctctctctctctgtttctcatgaataaataaataaaatctttttaaaaatgatttagaagcatctctctagcagctgggaagagcaagggctaaagagggggtggcaaactagaagcagaggaccaagtaaagagacatcttcaaaggtctgggtggggagtgctgcattccctcctcatggggactagcagaggacacctgtggctgaccaagtggctaagttgggggctaggttcagggggaaaagtaggatgaagattgtctccgaagctcatagaacactgaaaaccatgccacagtccaacagtgaaaactgagtcaagccctagaatccagaagtccagagatgagatttaggttggagctctagagctgagagttagaagctggaaagaagcaagactgggggagtaggtgaagaatgaccaggagaggggcacctgggtggctcagtcagttaagcttctgcctttggctcagatcatgatcctgggatcctggggtcctgggatcaagcctcacattgggttctctgctcagcggagagcctgcttcttcctctccctctgcctgccgctccccctgcttgtgctctctcatgctctctctgtcaaataaataaaggaaatctttttaaaaaaatgaccagcaggggtcctaagcagaggccccaaagcccaaggagagcttgtgattcatctgtgaagtgggtgggcacatggtgctaggggcttggggaaggccagaggttggtaggcaggcagtggcagcagggttggtaatgtaatgatatgctgattagctagacagtaaaatcactaggacttggttatagaatgggagtgggatgaggtgagtcaagaaagagtgtgacttgggaatccttccaggtttctggcatgggcaactaggtggttgatgattctgtcaactgaaaccaggattaaggaagaaggagcaggtgtgggagaaggcacaaactgcaaattagggaatgtctgctcaataggttgaaactgaaacattaatttttaagcaactggggacagtcaaatggaaagattcatgagaatctgattcatgagaatcaggtatctgagagtaaaggtcaaaggagagatctgggttaaaaatacacatttcagagtcaaccagcatagcaatgggcatgagagtgcctagggaaaatgtgcagatgaggagagaagagagcctggaccaagagatagaaagtagcttgagaaaggctgggaagacaggcagaaggacaaatgagaggagagaacacaagagagtgattttacaaaaaccagcagagaaaagaattttatagggtagtcaacagggtcaactgctccaagaaagaaaaacaaaacaaaggtgaaaaaaatgtccattagatttgcaaagagaagatctactgtgtgaaagcaggttcagtggaagggaaagaagtagagtggatgacagtgaattgaggaggttgtattagttacccacgcagcataacaaagtaacaaacagtagctggttacaacttaatagtttacaacagcaataaccatacattatcctgtggattctacaggtaggaatttgggcagggcatagctagggcctcctgtgtcttccctacaatgtcctgggactgcactgaaagtgactggacggctgggagctaaattgtctggaggcttttgcttgcatgtctgccagccaatgctcgtagttggttgaaaccttagttgaggttgtaggctcccacccctgatggctgggttcctggggagcaagcctcctgaggggaagagagagaagttctgacatttgagggggtacagataaagaatatgaagttgcaaggacttaatcttctggttcagcttgtggatttgagaaaaatgagcaagaaaatgattttatcaaatctacagcttgaacaaatcagataaaattacacaacttcatattctttattgatttagttacagatcacaacaatgaagatacacatggtcttcatttgtactcttttctcactttttaaatatctcagtaaattgcttccttggagatgctccatttttctttgagttccacattcatagtttctacttctatcttttttaaaaagattttatttgcttattcatgagagacagagagagagagaggcagagacataagcagaggaagaaagcaggctccatgcggggagcctgatgtgggactccatctcaggactccaggatcacaccctgagctaaaggcagacactcaaccgctgagccacccaggcatccctctacttctatcatgatttgaaggtgtactcattctcaatcatctatgatttaaatatatatatgcatataattatagccaacgtttacaaaatttaaatgtatttttatcaaaatatgtaaatgtaaaaaacttaaaatcattttagatgttatattttcttctaaaatactcaaaattatgaattgaaaaaggcaaaataaaaattataactaatgactattaatattctaaatcaaattaatttaaataaactcttttctgcttactttaaaaatcctatcaaatagctttatagaaatcaaactatttgcaatctagtattcaatgttcattcgcttaccaaacagaaaatcaatatgatactgcacaaaagttatgcctagacatacatgtatactagtttaacagtaataaaaatcatttaatattgcaaaatgttcctcagttgtcatttgcaactgtcatttgtgaatgcagcataatataaatcaatacctctggaacacaaagagaagcaagaaaaatggatactcaacactattgggaaatgatactttatcatgccatttgaaagctaatatttgacaaattaattaagttgcattttctcttacctaagtgtttctgccacttaaatcctgcttacacagcaacccagtgtgcacctctgaatctggcagaggcatagcctaaattttcacaggactcagttgtggtcatcttttgtttccaggatacagggcaaaagattgcagaagcatttccctggggcccagatggtgttaattattgagagcagatgttcagggtttcaggttgtgctgtgccagcactgagggccagattccaagtgcctgggtgtcatttaataatttttgtgtgtgataaggacccctaaagtatgtgggccagggcaaggcccttgtggtccagatatgatgatgacactgtgggggaagatcatgatttagtttcaaatatgctatgtttgtggtacctttgagacatccaagtagggttcccaatgtaagcagtcagatatacaagactggagatcagagaaaaaatacaaattttagagtgatcagctgatagcagttgaagccatgggtcaggtgtgatgagtcccctggagggaggatatagcatgagaagagggatttgggactcactgcccttgatgaattctactatggctagatagtgcaggatgagcccacaaagaagcaaggagaagccagagggaaaggaagaaaatcagaaaagtgctcagtcctagaaactaaatgaagataatgtttcaagaaagaattggtcaacacagttgactactgggatgaattcaagcaggggaaaacgggaaaaatggatttaatggcagaaatcattgcaaaagcagtcaagtggcatgagagaggtggacactcacctgcaggggttgaggaatgagtggaagtgagggaatggagaagtttttcccaattttttatcatgaaaagtttcaaacatagataaaaggtgaaagtatactacaattatcatttgtgcgtccactactttacttagatttaacagttctttttttttgatttaacagttcttatttatacatacatacaaatatttatgtgtttatatactttttaaaaagattttatttgtttgtttatttatctatttgagagacagagcgtgcacacaagtcaggagaggagtagagggggagggagagagactcaagcagactccgtgctgagtgcagaacccaatgtgaggctcaatcccaaaaccccaaggtcatgacctgagctgaaaccaagagttggacacttaaccaactgagctacccagacacaccagtacttatgtatattcttgaaccttgtgaaaacttaggaaatcatgagccttcacactttaatacttcagcatatacatccttaaactggagactttctcctatggtaaccacaatgccatcgttacaataggaaaatcaccattggtccctaatatcatctcatatgcaaaatatattcaaattcaccccaattcacctgcaaatgtcttttgtccccccccacccccaaccaggatgcaatcaaggcacacacacactttgtgtgagtcaggctggataaggtgattaaaaggtgctgggaatagtggaaggagagggggaggagagagaggttgaagataaaggaaggggaaagggatccagaacatggtagagagactggccttgggtgggagaaaggcagctcctctacatcagtggttctcaaagcgggggccccacaccagcagccataagcatcacctgggaactagttacaaatgaaaattctagcccccctcgcccaaactaatgaaacagaaatacatggttagcatgccctcgaggcaattgtgacacacagaaattgaacttatgctctcacgtgaggaacaaggggatagtataaatttggtaatggatgtttaagggagttcacctctgagggcttcaatttcccccatgacataagtgagattatcaagtgagagagatgagacagaggagagcttcacaggtcccaggatccgggagtttaaagtagccactgaccagtgcaatgtggttggatcactaaggaatgctggggctggtggccacgaataaggcatggtaactatttcccagttgtgcatcttccttcaatgtttctgggccatcagagtaaaatcctgaagaaaatagatccctggactcatctaggggtggggctttgccaggtaggagcaaaaggtgaaaatataagaggggcaaaggagttcgggacattgtcaagacagttgctgaaatgaaaggccatgcagggacgcctgggtgattcaggtggttgaatgtctgccttctgctcaggatgtgatcctagagtcccgggatcgagtcccacatcaggctccctgtatggagcctgcttctcctccctctgcctatgtcactgcctctctgtgtgtctctcatgaataaataaataaaatctttaaaaacaaaaagaaaagaaaagaaaggccatgtagctgaaagtgaataggacggactgatgggttggaagaagggaaatatcattgacctgaaggtaccgggaggctgagaaacggtggtgaggggctagacagggtgatggctgcaaggtcagaacatggaggccacatcatgcaggttgcttgaacaagggattttcaaagaggggctccttcagatgtccggggtgtgacaaagggagtggtggctggcttagagtgcagaaggtcctgggatgatgtcattgagttgctaagaggccaggtggggaatgggtcctccgtgtgggcaatgagatgggaagacacaatccactgggtgccagtgtccccttgagagaggtaaagcgaggtaaggtggtctggcaggtggcagatggtaagcagagaggagagggcaatttagttgaatgcccgagccacagaagcagagggtaattttaaattcaaaactggagcctggaggaggtatagtttggaggcagccatctagagcaaggaaagtaccctcacctataagaaaataaacagctcttatttcagaagacagcagaggaggtagtgcccccaggggagagttatgtttcatccaaagccgggaactgaagggagccctctaaggagaagctaagggaatgagggggtctgcagtttataagagcccatgagggtagctcagggaggggcaagtggagagctgggtcaggaccagagtacagggtgtcatggagacaaagacactgtagtgtagagtaggtgggcctctctataaaatggagatgacaagagtactgacctcagtgggctgctgtggggattaaatgacttgctgtgctaagtctctgggtagttgcctcacatacacttggctgtagctcccaaactgctggcacagcagcctgtttccccacttggaccctgcccctgtgctaggtggaaagcacaagcggcaagcacttggattggaaggacaagttgcatgagcagttgggaatgcaagaattacatggagatatcaagaagatcctaatgaaaagatggattctttcaggtagcagctggctgatacctcctataagtgggatctggatgagaaggcttcgttccctgagagcacaggaggttatattgctacacataaggccacttgtggcttctccaataatgatgatcatctctgtagctgtgtcctgggtttctcccaccacagcccacctcccaggaacagtgtcaacctcctttgactctgatctgatcctgaacttaaagttgactctgatcctaattccactttagagacaataggatattgcagttccatagacacatgactccttcccttccccaaacccagtgtaaggtacacccaaagtgtgttaaaatacacaaaacagaattcagcaaagttaaatgaaaaaaaaatccatgttcatagtgtgtgactttggaacaccattctcaataactgataggaaaaaaacacaaggaaaaatcagtaactgtatagaacatctgaagaacacaattaacaacttgacctattcgacaaatatacaacacttcccccaacagcaaaaaaaatccacattcttttgtatattgaattttacttactaaaaataaccccatgctatgtcacagaacaagcttcaaaaaaagtgtcaaaggattgaaaccattcagtatatgttttctggaagatagaaatcaagaataaaatttttaaaatactgaactgctcagatatcaagccacatactcctacataatccttgcattatggaagccttcacaatagaaattaggaaatctattgaactgaataacaatagaaagagataaaagatataaaaacttgtgagatacacctaaacagtgtttagagggaaaggttatagcattaagtcctgttagaaaaggagacggggctgacaaccaatgattcgaaattcatcttaactaaaaaaaagactagcatatcaaactcaaacacagcaaattgaagaaataataaagagatggcattaataaaatagaaaaagcaatgtccgatgaagaaattcaacaaagtgggggagaaaagcagtgccttgtaaagaacaagccctggatatgtggcagtcacattattatcactcaggacaggtggacacgaggctcaaagacagcttggatcctagccctggagtagactggtccaaaagcctacagatcccaccctgagtggagtgagatgagatttgggatggggaggttgaaggagggaaagagaagtctcaaaagggtgtgtgtgtgtgtgtgtgtgtgtgtgtgtaaaatagacactgttaattgttaaacccctgtgtgtgcagtgggataccaactgaggtgaagtggaagagggcaggaccacagagagaagtgttttgtcactaacactgttatagaatcgttggtgcatgatgagaacaataaaaagtgaatttcagtattattttaacattttctttttttttaatttttttaaatgtttatttatttatgatagtcacagagagagaaagagagagaggcagagacacaggcagagggagaagcaggctccatgcaccagaagctcgatgtgggattcgatcccgggtctccaggatcgcgccctgggccaaaggcaggcgccaaaacgctgcaccacccagggatccctattttaacattttctacagacaacacatcctcttgctcctgcactggagcaacctctccctctgcttgctgtcagtaagctgcagcccaggtgacccatgtgaataaacagtccatctcctctaccagattgggagtccttataggaagccatgtcaagtgaggattattttgcacgtgatggcatagttccgagcagcaaaaataaaaaataaatttaaaaatgtgtgatatataataacattcagtgtaggtctaaccactatcaaaactataaagcaatgatgagcacacatgacattttaagatttctgcaactggaaggtgatgtgatataaaagcatctgatttctattgatgacagtcacagatactgctaattctgctgtggtttgttgtctacacttttcattggaggaaatgctacatttccattagaggttcgtgaaaataatacgtaattttttctaattctcaatcacagagcctttaggatcttggttaagagtcctgcatgagggacacctgagtggctcagtggctaactgtctgccttcggctcagggcgtgatcccggggtcctgggatggaggattctgcatccggctccccgcagggagcctgcttctccctctgcctatgtctctgcctctctctgtgtctctcatgaataaattaaatatttttttaaatgcttctaaaaacagcttaaagggggtgtggagtgggtggttaggctgaaggaaaactccctccgtcctttcagagagatgggagccctgggggaaccttcgcagccacctgccgcgagaccaagcagcccggaacaactccatctcctggtcgatgctgccccctggaggtctgtgtgggtaccgcggctccctttcaccccattgcgacttcgcgggtccttgagagtccgttggagatctcctgggtgcccggggagatggatgtccccaaacactgtgagctacaataaaatgggaatgccttccggctccctaatcaagagcttcctcagactccggcaccgcccctcagccctgcaaaatgacgcgcttaccggttgtttgaatatttatttgcattcgggaatggacaggagtggcctgtaccgagtaaagtcaaagtgcctgccagcgcagcccttctcccacgggagcgtgagaggctttccacgaaggcgtctatcatggaggtagtctccctcgtgggggatccggagacctttgctctgggaaactgctctttgtcaaagccgcccgtgccgcctccgtcccgagtcccaaaccctgagcgaaccttctcctgaggctggagtcgggtcatataggagaactggctcccccaaggttgaaagtagaagcaggggagggtgtaggtgggcgggagaggcaggcaggaggacagaaggtcccggggcgagctgcggccctcgaagcccagcgcacctccgcctagagcgcggcgggcctcggggaacggctggggccgagtcaggcgcggtaacgctggaagggcgcccggagccgagggagcggcggcgccgggaggggtcggctgaggacactgccccggcccgcccctgaggcgtctgggccaatcaggagccgcccatgccccccgccgcccgacacccggcggcctcgggcgccaaggctccccaaactgaggacgccgctcggcggtcggcctcccagtcgcagcgcggttcccgagggagggggaaggcgccctcccgccacgcccccgcctcgcggcagccaatcgcaagagcccgcccgccgggaccgccctggccccgccccaccgccgccgccggcctagaggcaccctctcctccacccagccccaggcccggctcgcgtccagagagcccgcgccgggggtggaattctttttccttcagtagctcgctgggacttgggaagcaatgctcgggccatgtgggagaaggaaacagaggaaacatccccaaattaccattttctcccgactgcctgcgcctttcccgttaggactaaaaaggcgcccccgtgtctcttctgtctagagtctgagttcaaacgaggtgtaggggtgcagtaggaagcaaacacagaaatagatgaaacaggcacgctgcaaacctgtcccacccccgccctggtgtgagtgctacagccctccagccccccatgcaagttaagcccctgttagggaatcaaggtagcctgtggaacagtgcctgaggctgtacaaccgtgttcccagcccttgagggatctgcccctttttttttttttttgaggtatttgccatttttaaccaggggccaccttcctccaccaggctggttactcacgacacagtcccctccctaaaaccaacgctgctacttctttggcctgaagcagctagagattagaagttactatctgtaccccttcttctggacacccaccagaagggagataagcccaggagagagccagaacaaaaaagtgatcctggagcagaggtgggggccacttgaaggccccaggaagaaggaggaaggaaatgagagaagagtattatgtcatattaaatatttattgttttctgcagactgaccttggagtaactctcaagccaggagaggtcttgttagtgttcaagttgctgagatcttaggtcaaaaagctacagaaaagaaatcactgagtgaaaggggaaaaaaaaaaatcaatgacttgccttgccaccaattccaagagttgaggcgttgcacctcaggccatggtgacaagagttgagactgaaacagtaaagattttactgggggaagagaacttgggtgtgggggaaggggtggtgaaatcagggaaatgataaaggcttttggaagcccggggggagtggtcctgggaacccaaaaacaaggtgatccagcttattctgatgaggcagggtgaggcatgtcaaggacctgggaggcaggtggacaactgttaaggaaaccccagatgaagaagagtctgggatggggtacggaagtccatggagaaggcgggtggatcccagggtctggcgcatcaaaagttgggcttgtgcttcttgagctccaccataaggtgatgaatgttgataagctctgcccgggcagggagagctcggagctggggctgagagagtacccggtggaagcgatgatagagctggatcagctgggtcaaagctccctggtcagagaaagtcatgaaagatcaggctgtggagtggtgctagagatggtatcaggaatcaggctagggctcatccagaactttgggcatgctggtagttgaaggtcatgggtcacctggatgatgctgagcccagagaaaacaactaatgataggggttggagggaagggaggcctggaagctgcaagttacctggatgatactggttccatttctgaagttggtgaaactccgcattacatcctgactcagagactccactgatgatttccaggaactaccaaagccacggatcagttgagtaacccgggctgatggcaggagcaaagagagagggtctcagaaaaggacttggctaggtgatctttaacccttacgtcctccccaaggcacagccctcttccacatccaatctcattttcctgctctaccccctcctcatggaatctgcctcctctcatttttcttttccactccccttaccattaactccaccacctgaccacatcatctgcataccttcttcccctcgaagtcgctcagcctgtccacgttcaattaaagcctcggcttccttcacaaatgccaccagacccccaaaagggggagacaacaactcttcaatgaattcctgtagaaataagcacacacacatacacatagtcaaatgtcctggtatcaagacattttcccacttctggcatcatgaatgactagatcctcagaatattgccagagcaaattacatactttaagacaccaatggtcccaaaacactaaacttgaactggggagcaaagcacaagtaattgggatcagagccagaaccagaaaggtaggaagctgggagaggcaaggctgccagaagacaaatggcgatggcaactctgctatctggaatctgagcctgatgccagactcaagtggagaagcggagcctgggcctcttgtgagagcctcaaaggggtgctgacataaatcgaggtggattaggtctttcagtaatttgcctaccgtaaacgcagaggcaaatcctcttgacagaaaaatatcctcaatctcattttaggcccatatgactccccctgattaagacagagcaatgaactcaaagatcgtcagacacatatgaaaggaaactaccatgagaaacagtataaacaataagcaatggacttagactggtataccaaagactgccaacatcagaactgtcagatacgggcagccctggtggcactgcggtttggcgccgcctgcagtctggggtgtgatcctggagacctgggatcgagtcccacatcgggctcccggcatggagcctgcttctccctctccctctgcctgtgtctctgcctctctctctgtgtctatgaataaataaataaaatctttaaaaaaaaactgtcatatacacagcagttgtgagttctgtatgaaacattcaaagaattaaaaatatagacacaaagatgacgactcaacaagatgaggaatggacagacttgaaacaaaatgaaactttcaagagatgacttaaaaattaaaagtctttaattttaaaaagtcaacaggttatacagcagattagaaatacctgaagaatgatacagcaaattgaattttataattgaagaaatgacttaaaatgtagcacagatgagatgggaaattttgagacattgagggttatggaaatctagttcatggatgtaggcagtgatcactgatggctattgacagaaaaggaaccaagaaaccattatgtgcccccaatggaagtacataccactagctctcaactatccttggggcggggggggcgggggggtgggcaactaactgcaaactgatcaagacttttcatctaactacacatttatggaaaaaaagaaaaaagtctagccataccatggaatgcaatctgcaaaatctagactgtattctgttattctaacatgacagatgactcagttacttggtttcttccacagataaattgcagaggaggtaagcaaagatggaagggcactctatagatcacaaagagacatatgtatgtaccatacatggatgttaatttgaactataaaaaccatttatggggatccctgggtggcgcagcggtttggcgcctgcctttggcccagggcgcgatcctggagacccgggatcgaatcccacatcaggctcccggtgcatggagcctgcttctccctctgcctatgtctctgcctctctctctttctctctctgtgactatcataaataaataaaaattaaaaaaaaaaaaaagtcaaaaaccatttatgactgagaaaatctgaacactagctcttttaagatcatttttttaaagtgtgataatatattgtgggttttctttttttaaagattttatttattcatgagagacacacagaaagagagaggcggagacacaggcagagggagaagcaggttccatgcaaagagcctgacgtgggactcgatcccaggtctccaggatcacaccctgggctgaaggcggcgctaaactgctgagccactggggctacctatattgtgtttttaaaaacacatcctgacacagatgaaatgatgatgtataagatttaatccaaaataacgggggccggggggaatccctgggtggctcagcggtttggcgcctgccttcggtccaggcatgatcctggactccaggatcgagtcctatatggggctccctgcatggagcatgctcctccctgtggggagcctgcttctccctctgcctatgtctctgcctctctctctctttctctctctctctgtgtgtctatcacgaataaataaataaaatctggggatccctgggtggtgcagcagtttggcgcctgcctttggcccagggcgcgatcctggagacccgggatcaaatcccacgtcgggctcccggtgcatggagcctgcttctccctctgcctgtgtctctgcctctctctctctcactgtgtgcctatcataaataaataaaaataaaaataaataaataaataaataaataaataaataaataaataaataaataaaatctttaaaaaaaaaataactggggggcaggcacggaaggatgagcaatgggtgctgatagaaaggaataaaactgtccccaagtacttactgattgaagatctgtgatggtacttgggggtgcgacccctgggagaggaccccaggggatccactatgctattagtatgtgcatttgaaatctcccacaataaaaagttaaaattggggtgcctggctggttgagtcagtagagcatgtgactcttgatcttgggattgtgagttcaagtcccatgttgggtgtagagattgcttaaaaataaaatctttaggggtgcctgggtggctcagccagttaagcgtctgtctttggctcaggtcataatctgaaggtcctaggattgagccccgcactgggctccatagtcagcgtggagcctgcttctccctctccatctgccactcccccggcttgtgctctctcactgtcaaataaattcttttaaaaaaaataaaaataaaaataaataacctttagaaatttttttaaaatggcagggctgaatgaaagcagaaacccaagcttgatagtaagatctggtagggtgaaagtgaaacttttaaaacaatttccatttaaaaataaaatccttggggtacctgagaagttcagtcaggtgtttggctcttgatttcagctcaggtcatgatctcgggttgtgggataaagccctgtgttggggctcagtgcagagcctgcttgggattctctgtccctctccctttgcccctccctgctccccgcctcacccctacttgagcatgctctctctaaaaaaaataaaaatgaaaaaatatttttctactcttcccaccaaaaatccacttacatcactgaagaatgtccagtaattaatatgagatggggaagacattcctaagaacggatctttctataactgagggatcttcatttgtaatgtcattttgaacagagattaaataaccaaattcaacctattccagtcgcccaaatgcaataacccacttttaacaatataacagtggggaggcacagggaatatactgcaaaaggaagttcagctaagagagatgagctgtccttttttttcttttttttgagatgagctgtcctaacacagtagccatgactcacatgtagctatcaatcacttaaaatgtggttagttagggcacctgggtggctccgtggttgagtgtttgcctttggcttgggtcctgatcccggggtccagagatctagtcctgcatcgggctccccacagggaacctgcttctccttctgcctatgtctctgcctctctctgtgtctctcataaataaataaataaataaataaataaataaataaataaataaataaataaaatctttatttttttatttttttaaagattttatttattaattcatgagagacagagagagacagaggcagagacacaggccgagggagaagcaggctccatgcagggagcccgatgtgggactcgatcctgggactccagaatcacgccatggaccgaagtcaggcactagaccgctgagtcacccagggattcccataaataaaatcttaaaaaaaaaaaaaaaatagcattttttttttaagatttctctatttattcacgagagacacacagagagagaggcagagtcattcgcagagggagaagcaggctccccacagggagcctgaagtgggactcgatcctggatcctgggatcacgccctgagccaaaggccgacgctcaattgctaggccacccaggcgtcccccaatagcatttctatatggcagttaaaacaacaagaaaatttctttctaaaatgatactatttaagtaacaagtttatttaaaggacaaattctaaaagaatagatcaaaaagcctaaacaattagaaaaaaaaagtaattcttcctggtaagtcctagtactcctagtaattatccctaaataaatgtggatttattcctagtaggaataactacagtaacaactagcacactagggattgagaagaatattcttgaccagataaaaggcatctacaaaaacactcacagcagtgttactcctaatggggaaatgaggaaagcattccctttaaaatcaggaacaggataggggttctcactattacacttctattcaactgctcaacattgtcagagagatcctagccagaacagtagtagatcaaagacgtaagaaactaaagacaaaggattggaaactatatatttactcctaggagggtgaaatctacataatctacatattacatctaactaggaataactctggccaaagatttgcaatgtttttgtgttgaaaattacaaaaggttgcaagaagatattaaagaatatctttaaaaatgggaagcccaagttcatggatgagaagattcaacatcataaactatcaattcttcaaaattgatccaaactgatcaatgcaattccaatcaaaatccttaaaagttttttcaatgtgaaaacttaacagctaactataaaatttatatgaaaaaatcaagaggccaatatattcaaggtattcctgaaaaagatagaatttgcataattatatagcataatgtttgcatagttataaagcattataattaaaactgcacgacaggtcagacaaattaatcaatagaatagaatagagggaagacacatatatttatagttttgctatgtgacagaagcacactgcagatcaagtagagaaagggattttccataagtgcttctgggcccatcgttatctatattaaaacattaaattaggttctacctcacatcatacacaaaatcaattccaggtaaatttagagcttaaacataaaaagcaagattctacaacattaagaagaaaatgtagtataatgtttttctgatgttaggatgatatgagacttttcttttttcttttttaaagattttattttatttatttatgagagacacacagagagaggcagagacacaggcagagggagaagcaggctccatgcagggagcccaacgcaggacttgatcccgggactccaggatcacgccctgggctgaaggcaggtgctaaaccactgagccacccaggcgtccctgagatttattttttaagatcttatttatttatttgacagacagtgagtgagagagagaagagagtgcatcagcatgggcaaggggcagagagagaagaagcaggctccccactgagcagggagcccagtgtggggctggatccccaggaccctgagatcatgacctgagccaaaggcagacgctttactgactgagtccctcaaaagcccaatacaagatttcttaaatgagacagaaaaatcaagaaaaaatcagtaaagccaatcacattaaaattaagaatttgtccatcatgagacaacataaataaaaataaaaaataaagctctgaaatatatctgcaacctatacaaccaaaaaattggtttcataaatatattttaaaaattgtataaatcaaaaagaaatacacaacccaattttaaaaaggccaaatgctacaacagatattttatggaatagaaaactttgtataactacttaacatttgaaatgatgctcaatttcaatagtaatcagaaaaatgcatataaagacccctaaggagatacctataccagaatggcaaagatagtttggtaataccatgtgttgtagaaaatatagctcaatgagaattcttacacattgccagtaaagaaaaaactagtataccacttaggaaaactatatggcactgtctcataaggttgaatgctggcaaaccctacaagcaacaagccaagtcctacttccaagagaaacttttataaaacttctctccatctacatgcactaaaaaacataactgttcataaaacaactctcacagttgcaaaaaactagaaataatcccaaggtccacttgcaggaaaaaacgttacattcacacaatataaaattatataaagtaaaaaagaaaaagctgtagccatatgtcataatatgataatgttggaaaaattatgcatgaaaaaaatcctgtgattgcttttatgtcactcaagaataaaaataaaaataaaaatataatacaggtggggaggtacctggctggctcagcagatagagcccacaattctggatcgcggggtcatgagtttgagccccatgttgggcatggagactacttaaaaaaagaaaataaataaaaaataaaaacgttagaaataaataagtacaactaagttaattagttgccatacttacagctatatttttgaaagcaagagcatggtaaacacaatacttaggtcaagaaaagacttaaaagtgtgatgggcaaggaaatgggctgaggaagaattcattgtttaatgctggttatcgtcaaggtaggtgaaggcttcaggggtatgtgtatcgttaaaaaaaaacacaaaaggaaaggaaaccagtagttccaattctgggtacatgaagccctttacctgccactccctaaacacacacacacagaagagaaaatagcacatgagactctccctctcttcttccccacccccctacctgtgtccgagcattgagcagctgctggaaactctcaacctctttgctgtcatctgcagcccgctcctaagggaagacaaagggaaatctcaagtgtgggagaagcagcccttgacttcaggatatccccttccttccacatttactgtacttggccaggcaatgcgccagatgccaagaataacttacggaacaagaccaagctctgtcctcacagagcaaacagagcagtgggggaggccaaaccctctgggtagggaggaagagagaaatagtgtctgtaccattagcacgcccagcatcatgtcatagttgttgatcaaaaacacaagttgctccttccttgaggagaactcagctgccactcggaggacaaaattctccacttccacctggaaaagccagaaggaagaggtgacatgagaaggtgagggcacacagcgctcctcacactgcaggccactgaggcagcccagccactgggaagtctctcctgcccaccctcacctgtagctgtcctagcagctgcattgtccgttcattgggaactgtctgattgatgctgacaagagcagacgagaactctgcatatcggcgcgtgatcttgggaaaagaaaagtggtaataaaatcacaccatccccctgacccaaccaaagcaatcttgcaagtccctaggagctggcccatcaacctctgtgactcccacccccaatcactataataaatgatgccaaattcaccctgaattcacatactcctagactgccccacacacagagtgtgccccaatatccagccaggcccacaacacaactgggaacccgaccaacccccatagtgaagctagagccctgccttttgggaacccctttgttacccttgccctctctcacatagtggggccgagtatccagcccccctagccgctgagggtcagtgcttcggacactctggacattcatctccaggatcagctcaaaccgtggccacagcaaggcaagcacttgctcccagtacctgcagacttaatcagaattagagatcagctggcaagaaatgtgaggatcgtgatgagcactaggtgatacatgcaaatattgaatcgctattatcatacacctgaaactaagaggatactgtatgttcactaactggaattaaaataaaaatttaaaaggccaaaaagaaatctgggaggacggaggtagggtttctgtgggggaacccagctgatggctgatggaggttggactagtatgaatggtgaggcagaaagcagtactgtccccaggcagatgaacgggagtaagagtcaggtgtcaggtcagcagcagcccaatggtcagaacaggaccatgtaaagccaagggttcaagagcaatggggcatcaaggaccagaactcagtgacctgtccagggcaggaacatccctcttcgctgcaatgttacggaaccggaggacgatgtggatacagagaaaaacagcaatggcatcgtagcagtccgtgagataggactccaggtgtttctacgattcagggatagaagaattggaaaagagcgttcgttattctgtcattcctagtggctacagacaaatgcatgtactcctctggggatgcagccctgggagggagggtagggagctctcaggaaatgcctcctccttccctgtccactagcccctcaggtggtcctgctgccttgcccatcaggatttaagatcacaagcccatcacagcagaattcagggctgagcaccatttcaggggcccctccgttttcagatgctactgcctggctatgggtcagtagtaggggtacctcagggaccccaagctttgagggtttcatatgctctgtgagtacaaggcttagacattttagaattagggggggcctggtttcagtactaccagagctatgaccccctacagtgctgcagaggactgaggacaaaggggtctaagagcacaggagctggggatcttaccagggtcatgccaagggtgcgacccatgacagcatggaagagatcatgtgcagccgagccggatacaacaaagaattcgcagatgaaaagatattcacggcaagaattgtctaggagggcgtagtgctggctgcggaagagggcctcaaatggatactaggatgggagaggtgaagaagagggacagaagggatggaccccaatgctgactctccatagatattgctggaaaatcagcaagcctgggtaacgagagctcaggtctttcccatctaacccaggtgcaggctgtgaaggagcatcctgaatgggtactgaaaggggtagagggacgaggggctcaagagaagaacccacccccacctgctgttattgcaccacccaactctacaacctaccccaagatgttcccttcagccaatctctctctatatatgtcctgaagtcaacggtctcaaccctcttcacatcacagaacacttgggtgatccaagaaggtcattccccgttctaaggggattgatacaggggactgcagggcgggaagctttgcccagaggtctggcctctcctacccatgcccagcacaccctcatgactgactctcatcccttctcctaccctctgttctccccgctgggcagtgtggggcaccaggatgggggcctccagttcagtgggggagatgacagagccacgggtccccagggtgaagatggtgttcctgctgcggagggaaggctttgagaagaatcgtaaaggatcagagtcagggaaaacaactagatcacaatggtgacagactcagaggctcattacctccagggaccgcaggcagccagacacagcctagatgtccctccttcccagtaccttggccccacttcatctgacacccgggaacgggcttcagagagctcctaccctccctgccatcacatgtagaactatgtgtcaaaaggatgcatgcctttttcgggcggcagggggggagggggatagccattatcacattctcaaaggttttggtcccagagaaaaagacaagaagcagtgcctttgaggcactgtcactatcaaggcctactacgtgggttcctcagttctaggatatctttctttgctgtgtcttccacacccattagatcatccttctcggcaacttcctcatactaagaaaaaaagagaaaagggaaccagtaagcatctcctcccctgttgtgataaaacaatttttccccactgtccagccctgcctgggggtggcccctcttccccaatcctagccatgcctccctccttggcctcacctgcactttcatgagccgccctaggtaagagcgatagtaagacaggtagatcttgctcagcgtttccacatactcatccctgatttcctttgccgttgcccgttcattgcccagcagaaactggtagaagaacctggagaggccagggacaagtcagtctccccaccttccccaagaaagcagacccctcaccaggctgactgatggcccagaggccatgctgagcctttcctttgggcactgacctgtacttgagcagggccgtctgggggatctgatagttggtcattggttttctgaaggaataaatcttctgaaggatgaactctcggatcttcgtcaccgcctggacatggggggaggaaacaaacacagggcatgaagctgcaaccttatgactgttatggaaatggtggggggagggtcacatttcaaatacaggaggatggaggttggagaagacctcatcagtatttctgaaagtgttcaggggaacctagagatgtgaagatgagctctgccagtaaaggcagggtgaaattcttggggatgggctacagtgagcgctgctggggaaacccaggttgaaggtgtcagggaggctggttctagtaatcttgggggtatcatccccacccctcaccttcacccgtagccggtcaagtatgcctctgacatcagcacaagccgctgtgcctctagcctcctgctctcggactgcagccgccttggcatccagttcctgcagctgctccaggaacctaggctctgtcactggtgcctccagaattgccctgggtagcagggacaggtggaaggggttataggagggagacccagacatcagtaggtcccaaactatattccttacatccagcctgtcacctctcccttcacacgctaagtcacatagtcaggatacgtgtacaaagtctcctgttcctggaatctcccccagtcccacgtccataaagccttaaacctcccaactaaacctcccaactaaatgcctgactctggatattcctaatctttgatgcctaaagcatgcatcaaggttgagttgtcaaccacccatcagtttctggaaggtgcttgaagagctgaggccaggagacccatgtggtaggtcatcctagaccatctacctgctatagacattgtaactcttcaaaatggcaacttacatgatcagagcagagggcactatcagaccatcgacaagttccccaagttttccccgaactgcctggcggtttcgaagccgaatattcatggctcctgactgttcctgcagtgtccggatctcagagctaatagagctgaggtcactctgaaaagctcccaacatctgctccatgcgctggggggaggacagaagatgttgttggagcaccaaagggttggcaagggacaaatgggccacctaagtttattggtaaagtcttcagtatcagtcctcgaaggtaggtgatgaggtaagaagtacccaaaaggtcactggcaaataacattagttatggcagtagcaacaaaaaggtctgctaaggtcatcctgaacgtgaatctaactatccccacctgaggatgatgacttaaagaacaacaccagaccatgatctggttcagggttaagagggatcacaggtcatggttactaacctcaagaacagcatcgcaggctgtgatctggttgtggagagacgctatgttctcactctcctggatatctaatccacaaaaagtcaaggggcctcaccataaagctggagattctcagacctgtgggactattcccatttttcccagagatgacagaaactgccatgagaagatgtcagcccctgctgggctgcatgcaccatgctccgcaaaatctctattttaataacatcaccctttttctctactggaggatacaatctcgaatggatttctgctcaatctgctgtagttccagctcaacctgctttgaatagtgacggagatccacaccctaggggaacattaacacaacaggttaagaggaagtggcagtgaagagaccctagaaagaatcaataaaggactagaaggtgagacaccagggtgatgttgtaagagtgagagactgtccttttttttcctctttgaggggagggtaagaggagggataaatcagtacagcagaaagcctcaccgttttaagagcttcctttactaactcatcctccagatttgcctgaatgtgaactggaaatagaaatttatcataagggtccagctcccgcaaacgaacatctgtacaccattccccaccttattacttccagcaccatacctcttggatcacaagcagtttgcatccacctcatgccatcacttaccatccacttcatccagaataaattcatcagaggagatgtccaattctccaagtggcaatggctcctgaagaccagggccacccccctggagagggacaagtcaacaggaaagggcacagtaagagagagagagagaacaaatataacgggataatccacagaccttcaaggtttggggaaggtggggctgggctgggtttttattgggaagccatgggcactgggtcaaaaaattccaaaagtctcacactgtccccaatctgctatttggggctcctaggtagggaatataacaaaaagactcaaaagtcaccacaagagtaaaggaggagttgcagaggacagggctaaacttacagctgagtgtaggatccccagactcctgctatcttaggtgttctatcacaatccctgtggggatcacctgcccttctagaaatgtcagctaacagtgtttacctgcgggccaggtgccatttttcatacattcattcatctaatcataaccaacaatttctacggtgaagtcttatcatttccttcaccttatacgtggggaaagtataacacagagaaactgattaacccgcccaacgacacacagcgtgcaagaggcaaagctggaattagaacccaggcgatctgaccatagtcacgttcttaacctttacactatactgccgctgtattctgccctcagatctggaagttaactgaaattctgccactggcacctgagtcggccattctgactccagggcagactcagacccgactccaaggacggatacggaaaaacacacagggagcatcaccgttaacagccgctcgcccactcttctgcctaaacccagcccaggcccttctgacgcgaggacccccggacaagactccggagagaaagagccccacgtccgcaccagcgggccctcctcctcctccatatccgaggtcccggctctcagcagcagctctcgcgcagccgccgccatggtcgcagcagctgccattctgcgtagcctcacttccggcagctgtccagtcgccgtaggtccgtccctggggtggacctacaaatcctagagggtcttgcagagagcgaaatcgttcccagatatttgaattaagttgttggactccagccttcccctttcagccctaaccacttgacccaactgcaaatgggaactggatatctgaagcacaatcgcaccccggaacctttgctgctctccctcttaaggactttacgaacatgtaaagagaggccgcaccggaagttctggtaaagaagagagattctcatagttgaattagttctggcaccagcggcttccggaagcgctcctgcgtgatcgctccgcctcttccgctgatagctatataagcctagtatgtcacttccgttctctcttccacgggaggcccgcacgccgctgcagaggctgctgccatggtaagagtggatttcgtgcggggatccggcgacatcggaaccgggacacggaaagtctgctgttagggatcagaaaacgccctgttttaggggttagcaactttctgtgtgaatctttggagcgcacccctgggaaggaatgactgaggacttccagttctgtggagtaggccagaggaagagtcactcgaaaccggcgaaaaggcttgggcgtgaatggggacctgaggtctccgcctctcagtgtacttttgggaacgggcagaagacttgccccctcccagaggttgcgttttcccgagcttgaacacttaaggttttgcgagcgggactgaaggggggagggttgttgctcccggtgtgacaacccggacgttcctcttgacattactgtttgatggtggttgacggtgtcctgtttctccccctgtctctgccagtctctagtgatccctgagaagttccagcacattttgcgagtacttaacaccaatatcgatgggcggcggaaaatagcctttgccatcacagcaattaaggtaaggtagggtaaggaacggagcctgtaaatgagacaggatagctgtaagtgaggaagggtccaggagacatgtcccaaccagatcaccttagctgctgggtaaactaaagaacggttaaaagagtgactagtcctctggtctcttacatcatttccaccaaaaggtaagtaatgaaagccagagaagagtcgcacatcaagccaagatactctagatggggagtgggttccctcggcttctagaattcactaaaagtttgttggaccgtcacctgttgtcatcctgtgaagttcgttctaggtttggtttctgcttctgctccccactgcagagcatcgtgacagctacccttcctgtgacctacatgccctagaaattttgtaatcatacatggtgggtagtcgaaatgccaacagactgccaagtgtgaagaaacctatagttaggaagtgggaggagtatcattacatcgtgaacagtatttattccaatgtcagaggtgaatacaatgcatttcccctttctacctcataggaaccatcggtatttggctcatattatgccttaggtcggtgagcataagtttgggtgttttctttcactgacctaatgaactggccttccagttggggtcattccatcattttgttttgtttttgttagtatatgtaattgtggatatggttgaatgtggttttgccagtgtgtggacaccgtgggagcagggatagacagggatagaactgaacaaaacggggtagtcctattttgttcacagttcccagctcctggtgcataataggtgctcatgaaatgttagaaatggatccagggatgctgtagcctggtttcaaagaatttaaaggaaacataagtattaggtaacttgaccaatcaaagctatatgttctagctttggttcataagattgatcagatttctttggttcttttgttttattgcaggatgtacaattttcacttgttcttaaatggtaaataagaagattgcttttttctgtttttttgaaactagtaaggcaatataaaatatactagtacttttaaagattgctatgaggcttaaatgggatagtgaatagacctgcatatcacaggtctatattgtaggttcagttctaggcaataaagtgggtcaaatattttggtttcccagtgcatatgcaagttatatttactctaatcagtatttcagtattgaatgtgtagtaatgcattatgtcttttaaaagcacatgctttaatttaaaaatactttattgctaaaaaatgcatatcattgtgagctttcgaggagccatgatcacaagtcactataacataaaataattaaaaggtttgaaataacgtgagaattaccagtgccatgagcacatagtgagcaaatgctgttggaaaaatggcactgagacttgacacaggatttgccgcaagccttcagtttgtaaacaaaaccagggtatctgcacagcgtccttaaacaaggtgtacctgtattgaagatggttgcagttagtgggatgcttgtgttaaaccctttctctttgtttctgaaaattaattggatttgtatttactttcattaaatatgtcatagcctttgtaatccacttaaaacaatttaaccaaaggactttaaggtactttatgaactttgtaataagtctcttagggatcccgatgcttatcactgggaaaggttatccctagagatagattatacagagattattgctgattgtgtggagagccagcaaattgaggtagctcttcctctgatgatagaactgaagcttgaacaggagggggtctttttttgttgttgttaaggatccggaaaggaggaggggtaatacttggaaactggaacaaagtgcagtgtggggagctggggatggggagggattcctcaaaagatgtggttaaagagtggtaagcaagattaattgcctagggaaggatgaagaatggagtggaagttgacagtaagtagaagagaatgagcgagaatacagatcctattaagattattttatcctgtgatcccttcctaattgttttgtttctacttgtagacttttcgctatggctatttaaggttggctggtcttctgcccttctctaaatcagggtgacactgctctatgggttatttggaaacctggaagggagaggttggagttgggcataagagagatggtcccctgaatatacttacccttctggatggaggaaacaggtggtccccttggaaaagggatctaatttagaaagttggcaggtccgtatcagtcagcaaacaacgctatcaaaaatcttagccacttagggtggctctgtcagttaagcatctgtctcttcattttagctcaggtcttttttttttttatttttttttttttaaattttttttttttaatttttatttatttatgatagtcacacagagagagggagagagaggcagagacacaggcagagggagaagcaggctccatgcaccaggagcccgatgtgggattcgatcctgggtctccaggatcgcgccctgggccaaaggcaggcgccaaaccgctgcgccacccagggatcctagctcaggtcttaatctcagagtcagagtccatgctgggcatggagcctacttttttttttttttaaggtagtttacagcaactttttaaaaactttattatggaaaaattaaaacgtttgaaagtagagggaagaaaattagcccctatgaatatcacctagctaaaaacttgcaatcttgtttcatctatattcactatcatttaaaagtaaatctcagggccacctgggtggctcagaggttgagcatctgcctttggcttgggttgtgatcgcagagtgctgggatcgagtcccagatccagttcgctgcagggagcctggttctgtctcatgaataaataaaagtctttttaaaagaaaatctaaatctcagacatactattttatctataaactctaatgttgtttttgggtttcagggttttgtttttaagatttgagagagagtatatgtgtgagcagaggggcagaggaagaaagaatccgaatgctgaagaaaacccagcatgaagctcaatctcaaaatcctgagatcatgacctgagctgaaatcacgagtaggacacctaactgaataaactacccacgtgtccaagagacctaatctcttctgaatcaacctgtaatttgattttctaggtcaaattttttttttttttttttttttttttttttttgatttttatttggtggggagggggaaaagcagattgaccactgagcagggagtcctgcatggccctaatcctaggaccatgagatcctgacctgaactgaaaggcagatgcttaaccaacccaggtgccccctaggtcactttttacacagaggaaatatctctccatttcttgaggctgctgaaacaagttaccacagacttgttggtttaaaacaacaaaaactaccatagttctggatgccaaacatagaaaatcaaagtgtcagcaaggccatgctcttctgggaatcctatgttctggtggctgtcacccaaggttatcctttctgttgcttttgttagctgcatcatttctcctatcacatggccttctactttgtgtcctctccttttaaaaagataccagatattggattcggggcctgtcataatccagtgtaacctcactgtaactaattatatttgcaatggccctattaaggtcacatcctgggattctagatggacctgttggggtaggtgggcagtactattcaacccagcacatcattcttcacaattcatgtgtgttttcttcatgagttcaggtagcaaggagaactggtattggtgctgacagtgccaccagtttaagcattagttccttttcagtttcgtttgggcacttagctcccttttccctggtcatctccggacactgacaaaatcaagtttgtgatcttgggaaactgttcatgatggcgatggggtgatctgcccaaagaattatgacctttacagacccagagcaccacatcagttttgagatggtacccatcagttttgagagccaagccctttgtcctccacaatgcagagactagaagatactgtactgttcttaggtgctgttgcaagtgtctttaacagtcaacatctgatggctatatatgctgagcagtgtgaaaaaagattcttttttttgcccgacctacccctgaaaaagtatttaatagttagattctgtatttagaaaagtatcacactgggtggttgcaggccctacctttgtgtcctctttgaatagtcgggctataaagggaaccaaaaacagactcaaccccaattccaaaacctctccacagggtgtggggcgaagatatgctcatgtggtattgaggaaagcagacatcgatctcaccaagagagcaggagagctcactgaggatgaggtgaggagggagggcgggttggattggggcctgccttggaagggaagcctgtacctgactttttgtcctgcctgccaggtggaacgtgtgatcactattatgcagaatccacgccagtataagatccctgactggtttttgaacagacaaaaggatgtaaaggatggaaagtacagccaggtgtgtattaagatgggagagataagaggcagggtgtgtctagtcagaatttgtcctaggaggtcagaggataaacattcttcaccccctcttccaaatccaggtcctggccaatggtctggacaacaaacttcgtgaagacctggagagactgaagaagattcgagcccacagggggctgcgccacttttgggggtgagtgggggtccctccctgcccctaggctcccagagctttgccatgctctgcctccttccttcgcattgtgtataacctgtggcccttctgttttctcacctgcagacttcgtgtccgaggccagcacaccaagaccacagggcgccgtggtcgcaccgtgggtgtgtccaagaagaaataaacctgtaggccttgtcttgttaataaatcgtttatacacctaaggcttccttctgtgtgtttctcttctttctcctgggggggggggggctatcaaaccgggccctggggctgtttgtcctcttgtgggggggcctcattaacctgccccgggtgtgggctgaagccgtggcattgccaatcgccgccctacctgaagcgaccctgtggcgcctgcccactaacgttagaggtaaattaaaaatcactcgaccttgagggtgaccccaagcccgtttgtagacacggaggtccccccatttttgcgcagcggcgtggcgggcgcgtctaccctgagcactggatggcctggggggtatttacaggccttaggcgcccctggcttgctttaaaaaaaaaaaacaggcccgcggaggccggaagtcgcgggctgccggtagggataaaatcctccaaatctctgacccggaagagctgggctccgcggcccagcaagggggcgcgcgtgtggctgaagaggttcgccgccaccgggaggctgctctgcgtccgcggaacgctgctccggactccgctcccgccgccggtgctccgcctgccgtaccgcgtccgccgcagccgcgaagcttcggagcggcttccgggaggcgggtgtgcgcgcggccccacgccctccccgggagggaggcgggcccagccgccaccgcgggcgggggaggggcggccggcgctgcagcttaatctcggaaccgagctcgggcggcggggccccgacgaggtaacctcccgcagtcctggctgcggccccctccggcaccggtacccgccgcgcgctccagccgcccgctccagcctaggcgtagccggttagggacccggggcttcctcccgctaaccgccttcgtgtttccctccaggtcacttctgattaccccacgccatgcccctcagcctctttcggcgccttctccttgctgccctgctgctggtgattatctggaccctctttgggccctcgggcatcggggaggagctgctgagcctctctctggcctccctgagcccggctcccgcctccccggggccgcccctggccctgccccgcctcctgattcccaatgagaaggcgtgcgggggtcccggctccccacccttcctgctcatcctggtgtgcacggccccagagaacctgaaccaaagaaatgccattcgggcttcgtggggcgggctgcgcgaggcccaagggttccgggtgcagattctctttcttttgggagagccaagcttgtggcatcctaccaaggaaccccacgacatcgacctagtacgggaggcagcggcccagggggacatcttacaggcggccttccgggattcctaccgtaaccttactctcaagaccctcagtgggctgaactgggcagacaaacactgttctatggcccgctacatcctcaagacagatgatgatgtgtttgtcaacgtccccgaactggtatcagagctgattcggcgagggggccattgggaacaatgggagaagggcaaggagcctccaagagcagttaaggctggagataaagagtgggaagaaaggcccatcttgaagagccagccaatgcctcttctgtatctgggccgtgtgcactggcgggtgcacccctctcggacaccagggagcaagcaccagatatcggaggagcagtggcctcccacctggggcccctttccaccctatgcctctggtacagggtacgtgctgtcagcttctgctgtgcagctcatcctaaaagtggccagccgggcaccccctctgccactggaggatgtctttgtgggggtgagcgcccgacgaggaggtctcaccccaacccactgtgttaaactggctggggccacccactaccccttggaccggtgctgctatgggaaattcctgctgacatcccacaaactggacccctggaagatgcaggaagcctggaagctggtgggcggctctgacggggaaaggactgcacccttctgttcctggcttcaggaagttttgggcatcctgcgatgtcgggtaatagcctggcttcatagctgagagtgccatagtagaggagtgaggagctgagggtcgagccagcacacccacaaccttctctggcccaggcccaacacagggggccctgactggctgcagctgatcggtttcctctatcaaatgctccatctatcactgaagatggagggacacaggagaaatccaggggcctggcctgccagacctagtgatggtcaccaggaagagcaaaacaatgccgggattgttctctccagctatggcggggaaggggcacaagctcctcaataaacttgtctgtctacctcttcgagtgcagcgtagtcctcaccaggagtctaacaacgcaaacctggggagcctggaggctgccagaccattctggatgggaaggacatctccagggacatgggaaagaggaaggcccctaaggaacaaggctgaggtcatagtgacaagatagggggtgagggtaaaagcaggataccacgaccccctcagttcctagagtagtcccatgctgggcaaagggaggggaacaggtccccaggacgatctacacacattatccaaaaaaaacaaaacaaaactactttcttctttaataccaaccctgccccagagccagcagtctctctccagctgaggaaggggcacagtgccctctccttattccaaggaacagggtcacttccccagaggcaatcatggggacagatggcattctcaggccatcctggagcacggctcagcgtacaaatctgtccagggcagatggccgggccttcaggggcttggctttcttctcttgcttctgtggctgttgctcaaggctctgccggactttgtcctgggtagggagagggggcaagatgagatgtgtcaggctggcaatggcagaggcactagcaggaggatgcagccaagtaggatgcctagccccccccccccccccccccccccaaagaacattttaccggggggcctttttccagaaatttccccccccttttaacaaggttttttttaaaattcggcccttctgctttggctttggctggaagggagccttggcttcagggtcgtagccctaagggagggacaagggtgaaacctagaacagtctcagaggccaagaactgtggcagcccccatctcctgtgccatacttctggggacacagcatgggggagggaagttgtagaggtgagaaaggtttgagcaccagggccttgctccataccagtctctctatccgctccttcttttcttgctccaaagagatgacatcaacctctgccagggctcttggatccagacaaatgagctctgcaggcacctgaggtgtcacaaagggacaagaacaggtcaagagccataggagagtgacccaaagaaggacagaggccagggcgctgctgaatcccactcttcccaagacttgggacacgggaagctttccccaaccccagcccaaagcacacacagcacaggctcaccttctccagcagggccttcacctcccactcctggcgctgcttctggctcctgtaagggttattctccaggccatcaaaattgggctcagcagcccctggaggaagggagaagcatggagccataaaaagaacccagtccagcagctccagctccaccaagccctttgctcttggctgtcttgagcaaacccaaacttccaaccagagttcatccacgtggatcccatcccctagcctactcaccagggaccagcatgctggtgatgcccccactgtgccccagccccagcacatcttcaaaggggcagaaatgaagaccatgcacgtggcctgagagccgatgggtgaggtaaggctgctccagggacggggggctggccatgccctgccccatccatatgttgaccacgtcactcatgcccgcagccagcagtccccgctgagaaaaggccaggtgccccgctccctggggcagggtccgagcactcagaggctggaacatccctcggaggtcaaagatcttcagctggtggtccaggccagaagtggccatgtacctggcggagaagaggtcaattaatctgtcgtgtgggcttactgagcagggctatggccaagtgcgggcatgaagtcttgttggggaaaaacaacttttattccccttttacagatagggaaacaagctcagagaaaggagactagggtgaatggtatggtagagctggaattcacgtcaggctagaattcaagacccttctgtttgtcctcttgaccaaagtttacggtgcacaggcccatctataccaaaacgtgatgttctagcacacacacagtgcagtggctcagcaaagagaaggattgacaacagtggtcagggaggacttcataataaaactgggattagagctgttctagctcattctcaagaaaaccaagaaacatatacagcaggtaaaatgaatgaacatcagagtgtggaggtggtaagatggaagcagaggtctgctttcaggactggagggacatgtggtcaggaggatgacgaggagacagattcagggggctctttaaactgagactgaagacccaaccctgagtcatcaacactactctctggcattgagaccataagctgaagactgcaaggacctgagagaagctgaggaagcaatgacataacgtgctggaggatcctgccccaccctgtgtctccccagaagaagggaaggcacagaggttttgtctgttttcagaggttaggagtttctatgttcaagttgttcctcagagacagaggctgacggaagaccaggcaggccaggggatgtaagtttgccaataggccatggactctcttcttagctttggctgggaaccccagaagaggggactgaagggctcctacgagagggactaaccctgtgatggggctgaagagaggcccagctggatatgactccagacacgacaagacaatcaggaccccagctccaacagatggaaagacatcagtgctaaccaggaattactgacggctcccgagacacggggtcatacctttcattcaacccacaacacaagggcacatgctagcttctctccccacacatacccacctttgggatcccctgcacaaataccaccagcccattggccagaagatatccagggtacactaccacacttctaaactggcagacaacaatttggctctgagaatccaatccaatcctactgcaagctcccagaatgcctcgtaaggcagacagtaagcctcatctctggagcccctgtggcttgtctgaagcactcctgaggaggaccagagataagaagaggtgggctcaagatcaaggaccagagctgttctcaaggggttgaccaaatctcagggaacttaaggggtgaggccttgggcacagcagtacctgaccacagcagcccagagggaaggcaaaccacagcttagattcagtggcccacagaaggcactctcctaaagccaggttggcaaaaatatagaataaaaatggttgaagcaaatcacttgtctccaaagatacaattgtggagaacaaagagggtctgagcatgtggaaggttttcataaaacccaactttttttttttttttaagattttatttatttattcacgagagacacacagagagagatagaggcagagacacaggcagagggagaagcaggctccgtgcagggagcctgacgtgggactcgatcctgggtctccaggatcacaccagggctgaaggcggcgccaaaccgctgagctaccagggctgcccaaaacccgactttctttaaaacctttcctgactttaagactacttaaaaataaagttacatagtttatacttcatgtagaagattccggtgcagcagtataaaaggaggtaagtagcttgtgggaaagtcagccaagtagcttgtgggaaagtcagcctaggccacgcctggaggaagaagaaccagagtctggaaagtggctgtgagcatcgtgggtgttcacaggagacagcaaggacggagagaaatagaccttggaggggctctcgggaggaaagcagccaagacttcatgggtcacaggcagtaatgaagttctgtcaccaaagcaaggagcagaacctgggcactcagaaagcacccagatagccgaagactataaggctatgtagccaggtgacaggaagtcaaattctaggtgacaggaaaatacagtaaaaagagagctagcaaggaggaatctgcgagtgggctgacctatcccaggatggacacattaagtctggtgtgacaagtgacaaaagacaactcagcagaaactaaatacacctcctggctaattatttccataaactacagtccctgtctctgttcataaggtggaataccacaccatggcaagttccatggccccttcatccctgtacccctcagaactgcagcagagtccagcccacagcaggtcctcatatgtgagtgcctaacaggggtattaaaggaacaccaactaatcccatcagagggaacttgtgtggaacagtgtaccaggtatacacattaatacatacacacacatgcatgtgcacgcacacctcacacagcccagcagggcacctgcaaactcccaaagagtagagattcagagcatgcccaccactcctacccctcacatcaccagccaggcctaaagagaatgatcacttctgataccaatggtgaaacccagtgctccatgctccctgggcaccatgccttaactcgtgttaatgtctaggtccccagggcttgggacctacagcccatatgccagatccagcccaccacctacttctggacggccctcaagctccaaatgttttggacatttttttaagtgcctggaaaaaattcaaaaatattttgaaataggcgaaaattatataggagattcaaatttcagtggccacagaggaagttttattggagcacgatcacactcattctttggcttcttctgtggctgctttgtacaacagcccgggagagcagtcaagacccaacatcacgtatggcatgtcatctctttacaccactgtgggtgcactacaactcagtgacatggttacaacttgacagtgtttcatgtgccacctatctcatcgcttgtgtgaaagacgttttcaaagactaagtaaaatctctccacagactgacattaacagataaacatttgcaactgagtttgctgatttagaacactaactatgaacctcaactgagcaaaatgttatcctcaaaaagagaaatccaattcttcccattagtagacctgtattataaaaatagttacctgtactcggtaactattatattttgaatttcatcacttaaaaattcgtgatgctttctcattacttaagtacctatataacacactcgaatttgcctcttggccagcaaaacctaaaatctttttttttttaatagtttaaatttttttttcaatttttatttatttatgatagtcacagagagagagagagagagagaggggcagagacctaggccgagggagaagcaggctccatgcaccagtagcccgatgtgggattcgatcccaggtctccaggatcacgccctgggccaaaggcaggcgccaaaccgctgcgccacccagggatcccaaaacctaaaatctttactacttggctctttatagaaaaagctttctacctttgagctagatactcatccatactcttggggtaaggaaagcatgtagcacacagaggttctggaatgtgcccacacttacatggtcagtcagtggctaccatcacgatttatttactttattattatttttttaagtaggctccaccaacacaggctttgaactcaccactctgaaaccaagacctgaactagatcaagagtcaaacacttaaccaactgagccgtctgggctacccaaccaggatttacaacctagacagcctgactgtgagtctgtgctcctaaaggtacactgccttctatacctttctacccagctgtgacgttctcagcacctcaggaccaaacaagtgacttacgtgcctgtagaatctactgccacagcccggactccaccccgatgacagagaatctttgccagcggctccttcatggctggactccataaggacacagtacctagatgtcaggggagaggagccaaagtcactaacaggcactgaggtgattacctctgggaaagacagggtctcaagaccaagaggtaacgagagggaggaataggggctacttgaaggaacgtgcaaagtacaaacaaggaagcaaagcaggtcaggatggtcaaagagtcaaagctcagctagagaccaaccattgctgtgtccgagatggatgacagcattgtaagggttcttagtcatgacgtccagccgcccagcccgagcattcagagctgccacgatctttcccactgacacatccaggtaggtcagaaaccctgtctctgactgagagagagagaaagaatgagtcctgattgccctccatccttctactgagatcccagagaagaaacagttttctcaagggctgccacccagtctcttcactccagaggcactcacagccgtggccagaaggaaatggaaaggcaagaactccagccgtgtgactcggtcacagcggcggatacagtggagctcgatgccctggttgtcatagatgtgaagccagcgattctgagcgacagcaaacagtgcctctgaatgcaaaaacctggaaggaggagaagagtggttaagagggaaagagggtcaagggactgtcattcagtcaggaaggagatgccccacccccactgaccggatgtcccgcactgcctccatgacgttgatctcacacatgagcctctttgttacccagtcaagggtggccacatgaccccggtgccctccaaaagccaggtgtctgttggaggtgggggacaggcagcatgtcaacacagggaagcaccctgactcagaccatgaggtcttcccccccaccggccccgcctctccggataaggagatgctttacatgctcaccctcatatgcaaacaaatcacagaaccatccccacttcatcagcctaaacgtataccatatggctgaggtgagtgtggctgaaatggttaaggagatgaaccacatcctagttcaagagtcactgatatccaatcttacctcccaactggggagtaattcagtctgtagggtccaaactgcctcaagtttaaatcaaaatgctgagagagggaaaaatgaaaaaaaaaaaaaaaatcaaggaagaatgggctcctcttggtaatttccacctctagttcccacttctatctgtgccaccagtggccccttttccaacctcagactcaccttggctgcacttgcaatatccacagcctccacaatctcagcctggcatatctttgctgtgtcctccccatcctccccttccagaaacctaagggtgagcactagggttgcagtaaaacttacaaatacacggtgggtgtaccaacgtaaaaatgagaacgagaagccccatcaagcagggcctggggaggtccacattaggatccacttacccaggttcctcagcaagaagcagttcagaacgagcagctttaatacttatttcctcttcctcagcttcagccacctctagtcggcttcgtgttttcgacttcgaatgtggcagctataccagcgttggcaggagagtaatgaaaaaagaaccaggtgttatgtggggtgccaggagagtcacacagttcctcttcatccaactcactcatatgctctcccaagctgcaatccctcctcactcccagctggtcctcacctttttggatttgtcaatgcgacggaacttgcgagccacttcctcagggatgggagcagggcctggaaatggatcctgggcctggggaaggaggaagcaattagcagacaggttagggttgaccccaaccatcgcacctgtaaagtacaaggcaacttgccccaccaccttatcaggtcccaggctcaccccggacaaatttctctgaggctcaagatttctctgttctcgaggtttcttcgggaactgaggcttcccggggatccgagacttttttgggaggttaatgttctttggcctctgggggcggagctctcgattccttttcttgttacgagggggccctggagaggctccggcagcggtcagagtggcttccttctcccagtacctccgcggtttctacgggcagatcacaagctctaacactccatagccctcgcccccccacccccgggaccccgcagctaaaaatttcccttccaccctagcgaggtctctaccttcttcttggtctgaagtctggccttcttgggctggacatctctgccgggtttggaggctgtttccatctagcccaccggaacgacgacccacgtgcaaacttctctcagctgtccacagacggctcggaaactcccggaagcccgccggccctcgtccaatcagtgcctaccaggtctgaagccgtctgagcgccatcttgaatgagggcccactctctctccaggggcggggcaggtcttggctccgcaatcccgagcagccgcttatgcccgagtaatgaaagaaaggtagtctggggctggggacaaagtaacggtgcaggttttttttccagctccgtttccctgtcttgcctaaaacctcccgggtccagttttctgggggaacaccgttcactaaacgtgccaaaactacagttcccggcatgcgtcagaagacagcttccggcgccttcttttcccagcattctttgtttacttccaggtttagtaatagtgaagcgagaacgtgagtatggctgggttacggttgaggggcttggggtcttgctgcgcccgccacctcctggggcctgcgtggagggctctctgggacgaggagaggctgtggtgccctgggaggctgcctcgcaagagtgctgtcctttccgcaggccgggccagaaaggggagtttaggtacctcccagagtgagacccagcgcccgctcccactccccgcgggccttcgtccccgccatggctgagctaatccagaagaagctacagggagaagtggagaaatatcagcagctacagaagggtaagggagcagcgtcggcgcggcctcgccccagacccttcacttacagcccaaagccaaaccaagataatatgttgtgccccactagaggccccgcgtgcagctccttccccatctcggagctcgtccccacccactgacctgttgccgcctccttgtctacttcctcagctccgttttcttctcaccaggattggggtcaggcggcacatgtgatgtgtttaatcaaccctttcttcctaacccccagacttgagtaaatccatgtcggggagacagaagcttgaggcgcagctaacagaaaataatatcgtgaaggaggtgagagagggatatgccgggccagaagggacctgacctggaagtgattctgaccttgtatgtcccatccctccatcaggagctggccctgctagatggatccaacgtggtctttaaacttctgggtcctgtgctggtcaaacaggagctgggagaggctcgtgccacagtggggaagaggctggactatatcacagctgaaatgtgagtctttgttctgacaccctgcaaggcaccggacgcccccagcgtagaatgtcgaggagccgttggagtagttccagggtagccctgtctgatctgcttcctcaaaccctccacggggagtccaggagagtccaacccttcagcaccctcaagagtaaatcccatcaatttctcatttgcttgtctctcttgcctctcttcagtaagcgatacgaatcccagctccgggaccttgagcggcagtcagagcaacagagggagaccctggctcagctgcagcaggagttccagagggcccaggcagccaaggcaggggcttctgggaaggcctgaccccatgggggggggagggaatgaggcagctcaagggtctatgctgtagctaataaaatgtgaaaacccctggctgttttctgaccagccacttcctgtcatgatggtctcttccttgggccccttcaactttatatatatgccacctgcattactctgttcggtcccaattctcgtgactggaattgccacagagtaatcctccttttttcactgagactaaaatctgaaacgtctcacacctacttgcctatatacactacgcttgccttggttggcatgccccttaggaaacatgagaagagcatttaccacgcaatgatcattgggaaggccagtttaactacagagctcacggtaatctaaactgagaccccagggtgaaatgtggtgaccctcttgctatgctttcttgtcatcctccagaaagcaccagcatcttagtctcattctagaatttgtttgaatgaagtttaggctgatttaaaatcccagcatggaacactttgtgatgttgtaaggccctcaagtttatacgttatccacaaagtcattcttccatttctttgtcctaaaattgtttcttacaaatgtccaaccacggattgttctttaatctgctcactttaattggtgactggtacttgctatgggtctgtgacaactgagaagaaaaatagcaaatagagggagccagcagagaggttactggggagaaggaaactgttgtgaggaaactgttttcgccaacgcttcattttcagcaatggggacagaaaacattgggccccttgttctttggtgtctacctttggccatctccccaccgccactcccagaagctaaaccatacacaattcaaggacaggggagtagaatgtaggtagtgttttgatttattatcttagtgttgtcacagtgacaggaacacccagagtaggaaaataaactcctactagatcctacttcttgccatcccctctccccagggctcagagcctctaggcttttcctctccctcctccttgtaggcctctccttggccttagaatgctaggatgtggccaggaaccgggaactgatccctttttccagtactggccatgtgctgcattcatggaaagtagggagctatacacaggtatcccaacttggttaccaagataaccagttctcacaaagctgaatctctcagccttctggttaaaccagtagcacttcactgccccagggtggttggccacctttctggatttcttcccggtgcaacatgactgccaccactcaggatggcaacccacattggtgtggccaccatgagttctattgagctcgcagggtttcttcctcaaaacagtgcccgggcaatcttcctccctgtggccttgatcctgggaaaagaaccccctcctccctcacttgggggagttcctgaggctgaggggctgctggtgagacccagtgtagcagtagagggccttcgccgctgccgtaggaggaaatcgtgtgatgctccatccatagcatagaaaacattagccgagggtgggatggtcagctctgtgtgttcagagaaggaacatcaagagcgacatgatcattgcccccacaaccagttggctatggaagcaccactctcctcccaagtctgccttccctcacggcctcttacctcgctcccctggtagcagctgcactagctcatattccgaagccaccgcagagtcacgattgtttttcttaaggacacgactgatgacacttggagccttgtcttggcttgtcacctggcaggacaggagaccaaaagagcaataaactggccattgcctctgctttccatccgttcagctctaactgctgatcccaactgaaaatggtgacccatgtcaaacactctagaatgaacagggaagcactatgtagtggttacctgtaccccacagtgtccagtgaaataggactgcttccctaagaggaaactgctatggattctgaagatctaatatggtccccaaagttcaagctgcagcagctaatgccaagtagcctttattgtttttttaagatgtttacttatttactcatgagagagacaggcagacagaggcagagggagaagcaggctctctgcagggagcccgatgcggaactcgatctcaggaccccacgatcacaccctgagatgaaggcagatgttcaaccactgagccacccaggcgtcccaccaagtaacctttaaaacaaaatagctgacgggtgcttgggtggttcagctggttgagtgtcagactctcagttgtggctcaggtcatgatctcagttgtgaggtggacagaacccacgtccagctctgcggtactgggtgtggagttaagattaagattctctgtctccctctccctctgcccctcccaccccacttgctcacttgctctgaaaaatgaaaaacaaaacggctatcataagcacaggtcagaaccaaggctagaatcatcctcccatttggctattcaggacaacatctatagtcccacaaggcatcatccttcagccccactgcacggggcagcttcctcaccaagatgctcttgtagacactgccatcttcccccagctccatctggactcggatgattcggcaatcagaggcccctggcccagatcccccacccctgtattcagtccccttggaggccccttctgcacccccactgagtggggagccacaggaggcggaacggcggtgacctcgagaaggcctgggagaggaggctgggggagagaggtggctggggtccgccagactgtgcaggtatggagtgctttccagggcagagtccagagatgagacagatggccacttcatgtgctagggacaaacaacatgtgggactggcatgaaggcagagaggtcaaagaagaaacattcacaaaggcaaggtcagtgttgagatcagaggtcaggaacagagctcacctgggccagcctggtcaacagaggagcaggggttccaggtacctcctctccccccacactgggccggtcccaggagacaaggggggtgggtcccccgacagagcccaggaccctggagcaataaggcattaagagggtcagagggagaagggctcttctcccaaggagcttccccatggcactaccctctaactgctgacacccttactctgtccattgcgagatgaccagtgttggccgaagcacccttggggcaggagggtcactggtaccaggtggctccacctcacaggacactcgatggctgtgaagaggtccaatggacagatgtcaggacaggacacaccgatccccacactcagccctaggtctggagtcccaacctcacccagccagtcacctctgggcctctgtcagcggccgaagccctcgcagccactgctggatatcagggtcaggtcggaggtcatagccacgacattcgttctggagccgccgcagctcagaaaggacagcaaactcctaagaaggagcccacagactgcaggagccgatctcagggacccctgactttccccaccacctccccttgtcgggacatggttagagaggtctagcatcccatgcgtgcactaccctcaccttcctccgcttgtcaaaattgatgtatccgttctgcaagaatattggggatggggtgaagcccagttctgccacagagagaacataccctcttccacacacacatccacatccaacttctcaagcatttcacccactaggcctccgaatcctctgttcctccccagctccccctcacctctgccctgccccaagctctctaccttacccttgaaattgaatatcacaggtagaagtggtgtccattccacagatgggaaaattagggctcaaagacaatgaggaacttgcccaagatcccagtttttgtttctttaacaaatgctacatacgctaacactgcagacacgctctaagcacctgctgaaaagtatttcatttaatcctcctgacaacagactggcattgacatggtcaccgcgctctcacttacaaatcgctgagccacaaataagttaagctacttgctcaagtaacagaaccagaactccgacaatctggctcgagccctggagtttggtgctgacgccctgcaacacctttctggaaggtctatctaaccctgaggcccacctgttccctcatcacaatgcacacaacgaccttgcacaccacccacctccagctcatccttggaggctgcgtccagcatcacgaggtccttcaggaaggtgccaagatatgggaccacgccctgaggtcagaggtcaggatcagatgcccactcctgatctgagggctctccatccctctgcccttgcctatcccatccctccctcctgccatgcctcccctttccgtccctctgaatgcctcccactccacttctcactctttcacaacactcccccccaccctaccccaccccaccccccgctaggctagtcactcaccccaccccgggagccagagccagacctcggagccttcttggaatttgactccagagagggctgcagcttcacctcctgctggtgacaggacagggaggtaggggtgcctcaaggggagcagggatggctgggagcaccatggaacagggactcacctgcaagaggagctcccggctctgggaataattatcctcctcggagaagatctggcagaggctggagaagactcggaggctgtccctgggggtggggggcagcagccttgaggatgggccagcctgccccacgccccctcggcgccaggcaggtgcccccgtgctcccacctggtggcttccccccaggctgctcgaagcctgtggatggggctggactgcagggccgacaccacagcataaaccgaagagaagtttcggagcagacgacactcctgggggaggggagggtcacagaggcaggccagagctctgggcccactctctccacaccagggtccccaacagagccaagcctctctcttacctctgccacacggatccacttttccaggagccgggccctctgcggaggacgcagtggccgaatggtcacctccccgggcccctctccagctgaagtagctcccaggacagagctgaccactgcccctgccaccttgttgaactgtgtgacagtagctcggacagatgggcagaggtgggaatgtcccggccggtctctgtgaccccacaggctccccaggcactgagaggggaccagatggagaaacagctcctgtggagcagaggacagagatcaaggttcggagtcaagtgggctcagccttccaacatcaggggcgtgaggatcgcaggtggccaaggaaccaaaggggagcgggctttgaagggtaacaatcatggggaagggggaaagatcaaacagagtggacaggggaagctgggagcttgtttaggaagggctagaaacaaggagaaggctctggagtcagggggagtagtaaggggacagggggcacaggggcagaggtcagggtctcaccgcatctagcagggtcagctgttcggccaagtggtcagcgaggaacaccaggacatccgtggggtcagcagggggatcgccggggagggccaggggcttaggaaggtcgggggcctgggggtccacccggaaccggaggttgcggatgaggtcagcgctgccccccccaacaccctcccctgctgcataccctgtccgaagcaagaagctctcaagccggtcaagctggcccttgacctcagagccaaaatcctcagggtgagaggccagccaggttgacagtacagaggtggctaccctgggagaaggggaatcagccaggggtcagctatcaagctgcagctcagccagaggggactgtgaggttaacaatcagcggtcactcaccctattgtcctctctagttcatcagtaggatgagattcgagggcttccagcctaggaaggagaagagattcgatctgcccattttccccaagcccccagtggctttgactattctggggggattttctggctttaagaagtccagacacctccatgatccttggtcccttatgaccctgacctgtcagccacaagccctagcagggcaggggtggaagtgaaggccctgtgggtggccaggaaagctggtgtgaaggtcacgtcagcccctgatgtccgggcatccagcaggtgtctgaccagggcctccagagtgccagctcggagccttctggaggaccgagggggaggcgtcggggcctgggggagacagaaggaaagtcactgaccctgttttcaacttagcccctagacctctggggaaaatcccagactcaggaaatgctgggggctcgttatacgaagattcagagacggccaaaaacttgattgaccaaagtcacacggcagagttcaggtctccaaagagttggccagaggacaggagactgggaggtcatgggtcagaggtgagaagccaaagttaggatctcaccaagggatcaagaggccgatactggcggcttgtgacagtaaaggtggcaccattctcctcctcatcccagacagacacaggggcctggcagagcaaggaaggggaggtgagacagtcccacgccaccccctactgcccccagccctaatcctccctctgtacccctcacctgtggtggcggggaacagtaccagcgagtgcgaggggtggggggggctggtgaccccaggtctcccccactggggcctagacagccccccccaagccgcctcagggcccggtggagtcgagggggtggcagtgggggggtgggtggaatgcaggaaccctgggcccggagacctctgtcgccctttccccccagagctgaaccccaacacagcagagaagcaaggtgcgaaggataggagggggaagcgagaaaggcagaaagccagaggcagaggccttgaaagctggaacctcagtcacgggcacagccgcaagctccgccctcccccgcaggaactgaccgagccccaagagttactccttcaggggagccccccttccctggtccctcagtgctgggagaccccctcaaggtggcggctccaatgccagtacaggaaggagaaggggaagtcgggatgatggggaggggggttgtgcagccgactcagggtcacgtggccccagcccctcccccaaccgatcccgaaaaaccagccctgccagtcaccctgccctcacccaggctctggacccaggagtcctgggcctcggggccccgaatccaatttctggccccttctggggccccggatcccgctcctggccaccaccattagtcccggcggagagcaggtgacccccccggcccagcctgggatgttccctccaaagtccgagaacccgggcttcccgcctccactcgcggcccagcgggagagggggaggggtcacgaaatcgaagggttccctccccaatcccggagtcggagaggccggttactgtggaaacaaaccccaccccgccaaacaaaaacacggagggcgacggggaccgagacacgacggccggaaaggctggcgccctggggccggggcggggagagccagggaaggttcccgcgggccagtgctgagtcccaccgccagcgggagccccaggaactccgggactccccgccgggccgactggcagacacccagcaggaggccggagggagagaggagggacagagacccgagggcgaggcagagcgtctccgacatgtccacctcccgacttcccaccactcgcgtctcacctcgtcttcttcctcctcctcctcttcctcctgccccccgcccacgccccggccacctgggcccccaccctcttcggggtctcggctccggaagctgctcagcacgactcccccggggggactcgcgtcccaaagcagccgcaggggccgcgggagcatggccgagtgaaggaatcagcggggtcgggccatgggggcgcctggggagaaacgggggggcaggtggagagtcaggtgggcgcgggggatcggggaggggagggacgcgggtgagtgcccaggtgaccgtacgggagtttggggagggaagcaacacaggagtgggctatgggggtccctggtgcatctggggtttgggggtcacgagtacgggaacgggcagggtcacagggtgctcaggctctgacctgctcgggaacggtgggagcagcgcgggtcccgggccgctgttcccgtcggtctccggtccccaaccgagtccctggcccgagtcccctcctcggcttttccgcacccccgttaccgcccgccaggctcccgggccctcccgccctttccgctcgccccctcccccccccacgtccgcctgctcctactgcaggagccaaaacgggaaggaagtgaggacaggagccagggccgcggactcggggagcgccgggcgcccagcggccaggccccagcagtcacgggcccccgcccgctgtcctcggagcccccgctcagggatcctggagcccacgccgccccgcactcaatccgagtggattcccgtctcccgaccccgagggaggataggagccggatttgacattcccctgccccccgacaacaccgaagctaaaactcccgggggaagcgttttaggccgacagggatcgcttactccccctgacgcggttacactccccacccgcacccacgcctgtagcggaccggaatccagtccgcgttttccgagaagcgcggggttcccgccctcgcgtaagggggcggggcaggaagccgccacttccggttctcggttcctctgtcccgcgtttccggcgctctgcgtggtacgtgcgctcccttgggctcgccccgccttccccggagcccgcggcaccgggcgtctcgcccgccgctggtggcccccgaccctgcagcgtgccggggactggggtgtcgccaaagcgtttgagcgctcgcggtgagggcagcccgggtggctcagcggtttagcgccgccttcagctcaggccctgatcctggagtccggggatcgagtcctgcatcgggctccctgcgaggagcctgcttctccctctgcctgtgtctctgcctctctgtgtctcatgaatcaataaataaaatctttaaaaaaaaaaaaaaaagagaagggaccagaggtggttgttaagagcctgtgctcccttgccagggggacccgtggggtggaaggagacaccctgttgggagcataggacacaactttattcccgcacgattaattttttttttttttttatttatgatagtcacagagagagacagagagagaggcagagacataggcagagggagaagcaggctccatgcagggagcctgacatgggattcgatcccgggtctccaggatcgtgccctgggccaaaggcaggcgctaaaccgctgcgccacccagggatccctattcccgcacgattagacccgcttcggtctaattgaccgtcctcccttggaggtccctagtccgagctgccacttccttcctccagtagttacttcgtccaacactggctttcaaatacagaggacgaaaaaaggactaatgtttgcgttgagcgccctccagcgggcaccgggcctgtgcgggagcagggaccacgcggcggacggacggacacgttcctgcctctgaggaaccggcagtcccgggagcggacctctaacaaggattcgcacatctaacaaggacatctaacaaggattcgcacaatcattcaaatacaagtgtggtgaaccgcacaggagggacacgcggcggtgtgagggaatgaggctgacctggtctgcagcccaagaagggcgaggggtggacctgacatacggaacagacggggaaggtgggagccactggaaaagagaaatgacgttcggtgagatgaacactgaggaaagggctggagggcaccaggtggggttgtaggggcaggcagtggctccagccccggagatgcatagcaggacaagaatgggtttggcttctagggcactggttctcaggtgtggcccttgtcccagaggtcctggagactatttcagtgggtgtgcaaagttaagactattggtaacaatactaaaatgttccttgcctctttcactctctccaaagaaatgcaccctggagctttccagaagctgcatgctgatatccttgtcctcacaactaatggaacatgttcttgcgtattcttttgttaaatttttctccgttgtaagttctggtagcataaatatctgtagtttgtcacccacataaccgaaagctctttagcgtccttgacgctttttaagcagtcctgagacttaaagaatttgagaaccactgcactgccttagcactctaagaaaggaaatgctacagatttgtatcctctgaaaaagcattccagccattctgtggagagagattggagggagcaagatgatggtgtacaatttgggggagctactccagtagctcaggccagagatggtggcagcttccccaggatggtggtgagtggcctcactgtgctttctggaagaaaaataaaacgaggtgaggaattccaggttttagaaagagaggtgaaattgaaatgctcatgatcagggtcacctgggtggctcagtggttgagcaccctgccttcagctcagggcatgatgccagggtcctgggattgagtcccacatcgggctccctgcgtggagactgcttctccctttgcctgtgtctctgcctctctgtgtgtgtctttcatgaataaatacataaaatctttgaaaaaagaaatgctcacgatcagtccagaggtaaatgaaccctcgtgagcacagagggcagcagaacggtctctgtgggttttctgcttggcacacacagcgccgagtgattttgcctaatcctcccaacagccctctgaggctctgctgtctgtacagtagccaccacccacatgtgtctgtgcaacattcgaaatgtggccagtctgaactgacaggagctgacagtttatttttttattttttaaaaagattttatttatttattcatgacagatagagagagaggcagagacacgggcagaggaagaagcaggctctgtgcagggagcccgatgtgggtctcgatcccgggtctccaggatcataccctgggctgaagacaggcgcttaaactgctgagccacccagggtgcccaggagctgacagtttaaaagaagcacctgttttaggtgacttagaacagaaatactaaaatttcttatattgagtacatgttacatgataacattttggatatattagatgaaataaatggtattattaatattacctgttactacctttttattgtggctactagattatttaaattaacatacatggctggcatcatactgtcggacagtgctgcctaagtaatttttttatcttgacactcaaggaactgaggtatgaagtagaatacttaaggtggcaggagttaacccaggtctgtgaattccaagttctgcccccccccaccccatgccagcaggctccctccatgggtgagaagttccaagaggagctcaaatgacaacggaaagaaaaggaagaggcctgttaccttctcctttggatcttttgaagtagatctggaggcagctgtggagagagattaagaagggttgggatggaggtgtggtagggtagataggtgtcaggcttctgggagtaggcagggactgtcactgtggcaatgagagtcacacttacccacccagcccagcgctttgatgagcccgaggaggagaaaggcagacaggaagaggcccacgctgtcctccagggagggcccagagagtcctggcaggtggaagtggggaagagtaaactctgtagtatcctcctgaacccctggacccccaccaccccacccctggctgctcgattacccttctggctcctacctgccacctccagggtgacttctgcactgcgccccaaggtgggcaaggttgggtggtggacacgacaggcatagcgcgctccatggtgcttggctgtgactgggatgggctgcaggtgcgcagagaggctgacagagccatctgagtggtggcgcagggcggagagccagctctgcccctcagccttctgaaagctgccttctgggccaccccggagctcccattccacctccaggcccttggcaggatagaagcgggacacaaggcagagcaactcggggggtgcctccccaggggcagcccagacaagaggtgccggtgtcaaggatattttggggggctctggggagaaaataggaaaggagcatgggggaatcaatccacatttgtctctatcagtttgccctatggcttcccccaaactgaggtggtttggtttttttcttccaggatggggaacccacagtctccccactggtgcttcacaggaaaccccatgctgaaacccatattctcaaggatcctgttcctcatatttgggaaccttcatcccagtcacttaaattcccagggacctctacccattgcctttctgattcccaaggatcccagtctacctcctgccattcacccagcaccctcttctcccccatccttcctccattatggtatggccattatcaagtgcccacctttgctttacccatggggatccctgtaccccaactcactctgtacagaaagctccagggcaacctgcccttgcaggtatggcaggtgtacagtggccagataggtgccctcctggaaaggctgtactgcaggcagccagagggtcccgtttccagtccatggaccccatggatcatcatcatcccaggcggcaaatgccactgccccgtcttgggcagctggcatctgctcatgcagccctggagttgcagccaggagtaggtgcccttttcccaggtgctggcgtcgccattccagcccaaagggagggggacctggggccagtgatgcagcagcctcagagatggagggcatgtaggcaaatctcaagtccagcagagcatcttgtcccagttggatctgagcgatggggctgtaggtgaggacagtcagcacagctggggaagaggaggagaggagggagtagaaggggcatgaaggagagaaacaaagaggaaagaaatagagaaacagagttatagggaggagtacccaactcaaattcacccacccctcagaggacccctccttttccgataccaaaccatcttctagtctttcttctagtcttccctgcaaatcccctttgttctgggcctgcgtgcaacccagagcggctacacatgagcagacaggtctagaggtgattaggagcagtgagtggatacagcctttgaaggctggtctgagcacccagcccactcaagttctggggacagtgggctctgagtgcacttccaacacagcctgaaccagtccagtctccatgcaccacctgtgaagaaccaggcctttcttggtttgctggtaaagactgtgatgactcagggctgtcaatcctctggtgctgtatagagtacttattgactctggaaggttctggctctagcctagacccaaacagacatctatgctctactgaggcagggtatgccaattaagtgcctggagcccgccctccctggttaatcccaactctgccgctatttatatgaccttataggctagttatttttttatttttattttttttagctatttttttttaatttttatttatgatagtcacagacagagagagagagaggcagagacacaggcagagggagaagcaggctccatgcaccgggagcccgacatgggattcgatcctgggtctccaggatcgcgccctgggccaaagacaggcgctaaaccgctgcgccacccagggatccctttagttatttttttttttaagttttatttatttattcatgagagacagagaggcagagacgtaggcagagggagaagtaggctcgatcctgggtcctgggatcacgaggccagttatttcatgttgccatggctcagcttcatctcctaaataatgagataataatatgataataatacgtatctcatggcattgtaatgcaggttaaatgatttaatgcctctggttacccagatttattcagttcctgattctggataacaaagacacctatatgtgaagtgcttagaacagtacctagaatacagtaagtccaccaagtgtttgctgggattacacctaaccatctattagaccaacttaatgtgccccaactcaacagcatctctgcaacattccctcaccccgctccaaaagtccactctccctgccttgtggaaagatcaacccctactctggacgctaagggaaaatacttagagtcactcattctctcactcaactaatacttactaagcacctatgatactcaaggtagaggacagcagtgaatgagacaggcagtccctgccctcatgtttcttacagtttagtaagggagacagatgagcaaattgccaaatataacataccacctgctgtccccaccaggccctaattgtcttccagatagattctcacctctgactccaactcaagttctcaccaacatttgttaggacaatgacaacctcctcttgggtcttccttatcttcagtctctctcttcttcaatccatattctgcacagtgtgactacaagtctaagccgttcacatgcctgtttaaaaaaaccgagctaccaggatgcctgggtggcccagggttaagcgtcagcctttggctcaggtcatgaacaggacccatctttagaatatgctcgatcaatgttaggtgttgctattttcattactgccaccatcatcctcgtggacttgctgggtatctcagcaaaatcattccatctgtatttttctcattagtccaatgatctgttccttgcctacctttgtaagaatcaagtaaaataggggatccctggatggctcagcggtttagtgcctgcctttggcccagggcgtgatcctggagtctcgggatcaagtcccacatcgggctccctgcatggagtctgcttctccctctgcctgtgtctctgcctctctctctctctctctctctgtgtgactatcataaataaataaaaatttatttaaaaaaaagaatcaagtaaaatagcaggcttttggggagatggcacgtgccagcacacacacacattattatacataagacttctgatagttcactgtcacctataaagcccagatctcagggtatttgatgatccagcccaggccccaactcacctttccagacttctcttgcatcctaagaactggctccaaagaatccctttcttgaaactagtagaaattctaatcataaggcctttctttgctttggtctaactcagttccctgcctattgtctcccaaacatctaagtattccatgtcccccaaggtcagttccataactacttcttccccgaaatgtcagtccttcctgtaaaagtagtctttcttctcttgtgacactgtaatttttaatcctagtttaactcctacaaggttaaacttctctcaacctcatgggacagtttttttcaataaagtaaaaccaggggtgcctaggtggctcagtcggtgaagcgtctgcctttggctcaagtcatgatcctggggtcctgggatcgagccctgcatagggctccctgctctgcttctccctctccctctgtctcctgctcctcctgcttgtgctcttggtctctgtgtcaaataaagaaataatcttttttaaaaataaataaaaaataaacttcatttctcaaaatccagacacaaattttaaattattacaaatgattcatgagatgaataaacaaaatccgaagattttacagtttaaccctcaagctaacagtgctctttaatgtgggttgaaggagcaattttagacctgcatcccacaaacctgtcttgaaaaatacaaatgttaagcacaacagggccagaacacgaaggaaatctgtacctgtttttacatcacagagattttcgcttttctgttaataaagtgaacggtagacaactattataaagtgttagtgaaaaaaaaaatgtaagctcaaatttaatcaagtttctagaactgtcaattggcaggaagtatggaggacaggaataagaggaaaatgacacaatgaggagacagttgaccaaagacagaacatgggaagttctgctgaacaagtgataaaccactagcatttagggagtgcagggcaattatagaataaaggagacttgggcagcccaggtggctcagtggtttagcgctgctttcagcctagggtgtgacccaggatcgagtcccacgtcgggctccctgcatgcagcctgcttctccctctgcctatgtctctgcctctctctgtctctctctgtgtctctcatgaataaataaataaaatatttaaaaaaaaaaagaataaaggagacttagacaaaattgctgtgaactgagttctgtgggaccccctcaagttcgtatgttgaagctttaattcccatgtgactatactgttgacccttaaacaacacaggtttgaactgcaatggtccacttatatgtgggagtttttgtacagtacagtactacaaatgcatattctcttccttatgattaattttcttaataactcttttctctagcttactttattataagagtactgtatgtaatatatataacatataaaatatgtgttaatcaactgtttacattattggtaaggtttccagtcaacagtaggctatgagtggttaagtttcgggggagtcaaatggattcagattttcgactgctgggggtggggtcagtgcctctaacctcccaccatacacacatgcacagttattcaagagtaaactgtatttggagacaggggctgtgaagaggtgatcatggtcaaatgagatcattaacacagggctctaaccttatatgctggtgttctgttaagcagaggaagaaacagcaaagctcactttctttccttcatgtgaggacacagccagaagtggccatgtgcaaccacaacgggagagctcttatcagacaccaaccctgagagcattttgatcttagacttgatcttggacttctagcctctagaactgtgacaaaataaatttaaggtatccagtcgatgatattttgttatggcaacccaagcagatgcaagaaccaaatgtaaaatatagagacctgtttggtttgctatgacaatattttttaagcccttatttgatagagattcttactgaagtacttatgaataaaatcatatggtgcctggtataaatttcaaaacaagaaaataggtgggaggagggtcagcaaaacaatgtggtaaagcctaataactacacaagtgagtgggtgattggtctatgggggttcattagaccattctctctactttcatgtgtctttgaaattttccattacaatgttttaaaagaacaatgagattttaaaaaccatacacgtgaagtatagtaggacagtgtatttgtcaataaacattttgaagtatttgataagaaatactgtataaatgtatattaggaaaaataccaatgatctgtgcccctaggaagattcctttttaaaatttacattaaaacaacaactttcattttcttcaatctctaatcaagtagaaatgcttgaaaaggaagaccgagcacagcaactagtttttacccccaggtttgggtctataagaagcagaaaattgtcccactgggcactcctacggctcctatctgcacttctcttatggcccaaattgtcttccactctacaattagccattataaatctactgagaaccttgagagcagaatctgatcaccttcgtgacccttaaaagtgcccaaggccacctcagagattctgatttaatttgcctgttgtgggacaattcagtgtcatttagaaacttccaagacaggggcatgtgggtatttaagttggtggttaagtgtctacctttggctcaggtcttgatcctaggctccctgctcagcggggagtctgctctctccttctgcccttcttcctgcttgtgttctctcaataaataaaatctttaaaaaaaataaaataaaataaagaaaaagaaagagaaacaaacaaaaaaacttccaaaaggactcttacttgcagcctggattgagaaccaactggggcctaatttcttcttggtgctaataaatattgaaccagtgaattaattaaccaagtgtctcccctgagagtcacaacaacagaaaagcagcaggaaatagcatccacattttacagttggaaaaacagactcagaatgaaaagcctcttctcacccccacctcagtgaagccagcaggcctgggagatactcctccccactggagagagctataatccccatagtttgcctctgccctgcccagggtgaggcctggcaaccaagaacgtcaatgtagacagaggtgatgggtgggtgctgagtccctttccctggtcctgtgggtgattcactctctgggcgggggtagggggggtgggcgggtggggggggggtgggaagaaggtagtggggggggaagggaggggttagcttgccagttgtgctgtgttgtttacaaaaatcatacaagaggcatctggctggctcagaggagcatgtggctcttgatctcggagtcttgagtttgagcccggcgttgagtgaagagactacttaaatacatatatacatacataaactttaaataaactttaaaaaagctcacaggactgcgagaagccaatgactgttcatatcctacccaccctctgccatgagaagggtgagctccgaggtgccccattccttttttttttttttttttttaacattgtatttatttgacagagagagagggcacaaataggcagagagagggcagccccggtggcgcagcggtttagcgccgccggcagccgagggtgtgatcctggagacccggatagagtcccttgtcgggctccttgcatggagcctgcttctccctctgcctgtgtctctgcctctctctctctctctctctctctgtatgtctctcatgaataaattaaaacacacacacacacacaagtaggcagagagagagagaagcaggctccctgcctggcagggagcctgatgcagggctgcatcccaggaccctgggatccagacctgagccaaggcagaagctaacccactgacccacccaggcgccccctaggcaccccattcttgctctatctgcccactccctcctgcctcagctcggcaaaccgccttgcaccgtgcaataagcagcgcttgcagtgggaagctgtctctccggcccagtgcagccccaccacttggcggccacagactcagggcatccgcacgagccatggaaaggggctggcaaggaaggcccacgcgctagagcgctagagcgctagagcctttgttgctctgcggggtgccacagttccagaagcgggcacgggcggggcttgaccggtagtttctgaaacagggttaaccaccaagacggcagtgtctacctagcaggacacagatctgggaggagaagagaaaaagagttccttcttttggggggcttctgagcccctcaaccccatccccatacaagttcctcaaggtagcaaggagtccgactctgtccgaagccccgtccccaacagagggttgcgcttgtttgctcgaaacccctcgggagctagaagcggtggagaccgcagctctaatcgcagcggaaccgcctcgctttaccaatcaggaaactaagccccgattgggcgagggggctcgcagcgcgagtcccgccagacccaggccctcagcggcccgcgttcctcccacctcccctccccagctacctgtcgccgaagtgaagagcgcaggctcgggctgaggctcggactgcggtctcaggaggcaggagaggctgaagatcgggctgagcacactggccatgagccacgccccgtccagggcccgcgggcagctccgccccggggtcaggccacgggcccacctcgccgaggcgggcagcgggatgaagcggctgagctcgcagtgtggcgggggggcgtccgaggggtacctcctgacggcggcctggagggttcccgcggggtctgtgcgcggagaagggagtcggtgccgccgttcccgccggcaacgggcggggagggcaggtcccgggaattccaaacgcacaaactgcccggtagcgagagtttagaggcaatctgacctcactttacaggggaaactgaggcccgaggtcacagcgcgacctcaagggcagggacagagcggagggcgagtccggaacgactcaccgtgcactttgaggtagagctcgggttcgaggtccggccgcgggggtggagtgcccgggccctggcgcagcagcagggccgcgggtttcttggccaggcggcccccgcccgcatcctccaccatccagcactctatcaccgccgggcccgccgagacggccgtccccaaggctgcggagaggggcgcgggtgagggggcgccccacgccctgggtccgaggctggcgcgcggtgggctcacctccctccgcccacccctggctctcgggcaaagggtttcggggttcgctcacccgacgccacggcgaggagcagagataggggcttcatggcgccgcgatcagctcagccccggagcttccacttcccccttcactttcgctttccttgaaagggcggggagaggcggagaaatacccgctccggtccggtgagggcacgtgggcggcagggctccccaaaccttatctcccgctcgagaccggagacctcagccccgccccgccctcttgggccacaagacaccacccagtccaagagccctccccaaccctaggctccccctccgtccccaccaccccaccaatccacttcccggagtacggagactccgccttcccccacctgcgccgggtccccagcaaacacagaggggctttcggtaagccgagtgaaatgaccaataaatattttaatcaccatttaaaaaaaataagatttaaaataaaaaccttatattcttacgtcttcactccctcctcaatgagaatccagttggggtgggggggggcccaaggaggaatcggagggatgagggtagaaatatagggcacgtccttagggaagtggggtaggtgctaggacaaaggcctggtccccacaacaacacaaacacaaacttcaggtacagactacaaccacctgacccttgaccctgtgactccaggatgctccatggtccccctttccctcccccccaccatatgcgtcctagtctggagctggggcttcagtgtacccatctgaggggaaggaaggacttagttccggggatacttcgtgggagaggggctgaggaatggaatggagtggctaatggtgcaatatggttccccctccagaatatatacaagtctgtagagataaggaagacattaagtgaggcgggagatcacctgagggccacggcggcctggctcagcctccgtttcctcaaaccggaaagctacctccagagctgccccttcagtttgttcctccacctccaccaaagcccatctccaccttgtggacgctgggtggggaccagaccctgcggctggactggggcgtggccccacttgcctcgtcaccgctgcccccgcccgctccaggggactctctcttgaggggcaaggttggcccggtgggccccccgggtcctggcccgcccccgcccccgcccccaaccaggcggtgccttcgctcacagtgtccccggtggcgcatgaagctgtctcgccacatgaacttcttggcgcagacaccacactcgtagggtttgaggcctgtgtgtgtcttcatgtgctccgttaggtggtgcttcatcttaaactttttgttgcacacggggcagtcaaagggccgcaggttgaggtgcatgttcacgtgccgatcacgcatgctcttgtgtgagaacgccttcccacagtggcacaaaaagatcttattcccatccccactgcctgtccctccgggggttcccccaggaccaccaggcatgcccagggcccctgacgacgtgccccccagggtcaccgccccgtgttcagcctggttccctggtggctggcctggagcctgtgaggaagaggaagaggaagaggaggacgaagatgatgggaaaaccaggatctggttgccctgcatgtccaggggaagcaagggccttggagggtgggagggggcataggaggaaggggttggcccccctgaatcatcaagccctgctccaggacccccaccgtcataggagccaaagtcattggaagactcacagaaattgacctgctcctctcccttgtccggaggctcagtcagggtgcggacatcacttatgcttagggtggcctcccgtcctcccgcctcgggaaccctggagccaccccccagctcttcatcttcatcatcctcacaggtcaacaccaggtcttcctcctcatcctcttccagatctgggtcttggggaaccaggggtgctggtgctgggctatttccaccccgcttcacatatacccagtgtttctgtggcatgatgctggggggtgcgtaggtgggccgccggagcccagccccaggaaccacaggacccctctcgtccccgccgtcatggcacagctcatctgcctccagcagcagcttcccagaggtagcccccccactgccaaccacaggggctgggaatacagggccacctcctcgacgctccccgctgcccaccgcagaagctggaaatgcctcttgggaggaagatgagaaatcagtggactctcgggggctgaagtagttgctgctgctgggggactgattctcactggcccgaatggaggcatgggagcgcacggagcccacggtggcagggaccacagtggccccactccccgatgggaccccagcaccaggaacagtgtcagaggtggctgcagcaggggtgatggtggtggtagtggctgaggcccggccttcgcggaggagttcagtgcacttatccacgatgtgccacatttggagcaccgaccccactgtgagaaagttgacaatgtcagcagcagccatgctgagacggccagtgtaagccgaagccaggacagtctcgaaggcgcctgggtccatgacgctgggcagcgagatggaggtcatgcccttgagtaaaacctggtcgtggaagtaaggggaggaggcagccaggacagcacgatgagccctgaactctcggccctgcacacggatggacacgtcgcagagctggccctgtagccgctgctgattgagggactccagaagggcactggttacctcaggaaaggacacgtgcaccactgcagctgcaggcaggggcagtgggggcggagccagtgacagaggcagggggagtgctgccccactgggagagagaggagatggctccatggcgtggagggaggggttacccccccagccacaggaacaagggaaggaaaagggcggccgggggggtctctgggaagaaaaagaaagaagaaggataacattccataatgacacagcccttcactttacagtttaaaaacatgttcgtaccctttatctgagtagttccccacaacaccctaaagtaggcattcctctcaaccctatttgacagatgagcaaaccgaggctcagattacgagattatccaagatcacacagccagtaactggcagtgccagcaaacgcagatgtcctgattccaaatgcagtgctccttccttggatattaagagaagtaaggtactcttggggagtggggcgcctctcctcagaactccccatttgcctgagcgcctgactttcccaaatctaccttactggtgttttgcacccttttcttgggagggggcaagtctgttcctgtactaagaacatccctccctccggatctatgccccccagctctttcgcgagccaaagcccccctttgccccccggcttacctctagccccgccccttcaagacacgccccgtgggctttcggccccgcctcttcaagacccacccccgtggccctctcggccccgccccttgtctacccccgcccacgctggaccccgcccccctctgctccgccccaagcgctacttcgacctcctctcccacccggaaggcgcccccaaccccgcgcgtccccgcttaccgggccgcgcgcccccgggcccccccgcccctcactcggcggccagagccgcagcctgggcccctcccgccgccatcttgcgccgactccctccgccctccgcctccgctccgcctcccgcccctccgactttaaaggtacaggcgggcacccctgcccgtgccactaggcaatactcggccgactcgtccacttctcctttaaagaacagccgcctcattccaccttaaaggtaccaggcctcttctgccgctgaagaactcaggacttggtggttcggccgaagcactcattcccctttaattctgtaagcctgcccttcccattggcgaagggtctcggccgtcgctgcttaggccccgcccctgagctgtggcctttagtgggcttgcgggatctaatcgccctgctgtcccagcttctgacagtcccccctgaagtcccgcccccttcctccgggcacggattggccaaaataaccttgagtcggcccctgattggcctttttactcctaccgctcgaagtgagaaaagtaaagcgagtttgggaggctgcagcaagttgattttttttttttttttaagtgcctggccgagggctaggggaaggtctgagggcgagggaactccgggaggcgagctaaagacaggctacaaaggacagctccaaggggtagcccaggaccaaggttaaccctgagccagagaacgactggtgccgagcggtgaacgtagaaggacaaggaaaaagacagggatacaataagaaaagaactttattgtttattaatgtttctgtgtaaaacttaagtttttgttggttttttgtttttgttttttaaagaaacaccaccaaaaaggggattagctcagtcaatcccttcctcagtcatcagcttcccaccatcctccaaatactatcccaaaacactttggaggctgggagtgggaggagaggcagctaatcagagtctgagagcacgatgatctcctctggatcgcactgtgtggccacactcatctgcaggggagtgagagacagagtcagaaagcagcgtccggaatatacggagaggaggagcagaggaaaggacttatccgagattaaaaattggggtgagaaaaaaaggaagagagaggatgtggtgtgtgcaatattcagatgaaaatcctgaaactgaacagacaatgaaagagaattaagtcagggaaaaactgcctccccctcttaccttgtaggtaccaggtctggagggctgtgaatgaggggtttgggacaaccgggcttgagatgcgctacagagggagctggtcaccaggccatggctaggagaatccaccctcgttgaggaatccgcaactggggccatggaagtcaagggagaaggtgggctgggcagagtaggtatcttccttccattcttttcatgcactgacctttgcctttccacatagctagggacagaaatgcaaatatgtagggaggtatggagagcctgaggctagagggggagtgtccagtttctcccagcagacccagttcctcaatattcctctcagaaagccccctgtaatgtctccttggcctccctattcttcctccttgttgttgttacctgtttcctaatggctctgctccagtttccttctccttccgagacttcttgcaggggggacaggaatctccccaggtgtgaggagacacccctccattgaaggaagtggaggtgaccatggctgctccattctccaagacagtggtgagaggttcctctgactgcttcctggaagaggaaatgtccctctcctcaggggaaggggtagtatccaggggcaaggcttcgatctctagctcaaagagctgagatatagggctctcttcctccaggagtaactcctcaaggttttctccattgctttcagcatctatgctggagggggccaagggctcttctgatgatggtgacaccgtgaattctttgttttgctgctcccccatagacctgctgatccctttgctaggttccagattcttttcagtggagatccgtggtggggacatagggctcttgtctccatcctgacctggaaaagaagaaaagaggggagagggagcatgagaacttggggaaagaatactgctgagagtaagaggaagaagggaagggtctcaaacaggtggttcacatccaacagaatggagggaactgacacaaaaaggaactgttcttgacatacctgcctcctcctcctcctcctcttcatcgtccccctgaccttcttgcatctgttcgagatcctcctcttcttcagaatctgtggcctcctcttcttcttcctcttcttcctcctcctcttcctcttcactttcctcatcttcttcatcatctgtctcaggcttggaggtggtagggcactcctgggatgccattccactagggccctggggggacaaaggagtttctgtaaggaatcccttgccccagaggatctggttctcgtgttccttccacactcttccccctcaatgaccctgaaatccttgttggccagtgcaaggaaaggacaaggtctgtctgaagggtttatcccttccatacctcaccagaatccaaggaggctttgagggggtctgtagagtgggaagaggtagcttggggaagccgagctctcctcttctgcctctcaccctcctcactcttgtcttgcatcattgcatatttggagatgacctcatccagccggctcatagccaagctccggttttctcgcaggcgccgggctagggcaggatctgacagtgcagggtcaatgcctacatgagaagatataaagtcagagtactcagcccaaaccctagaagaagggactagagagatgctccctccaccaaacatctgacatacaagggttaccagtaggcatctcactaatccctacctggcctgtagtcatctgtgaggtgacagccaaagttgtagatgagatcaaggtgacgtcgctcctgtaacctgatgcccacgtctcggaaggcatcctgagccatgagctggagctgctgtcggggaagaccaaggctgtgccgagcagctgccttctccacagcccgcagtacatctccatagtcagggaaggtatctggccctggtttgttgatgagccgctcaatgcgcctgttaacctctgggtagcgggtgccacgatagggaatgcgctgctctatgacacggcccgtcagggaagagcagtctttgagctcacaaagccgcccaaagaggcggatcagcttacgcttcaaccttgcctcctgcaggtatgtggagtctgggtcgtccaattctgagagatccaactctttttcctgcagccgccggatctctgccacatagagcgctagcagctgctccaagcgctggatctgccgccgggaaccacgggtccttggtgcctcagaggcagtggtctcggcatttgtggggtccgaggaggggtctgtgggagggttattcccagagggttcactagaggtggcagcaggggccaggttcagcttcttcttggctgaatgggccttgagaacagtgcagagctcattaatgtagacatagagcttagctggccggctctgggcccgggataggacccgagagaggatgttgcagaactccgccgaagccaaaaacagagagtgggcacgctgctgccggttatagaggaatgggaccacctcagggtggtctgctgtctgcatcttacagagttcaaggaactggaggtttcaggagaagaagggaggggggaagagacaaggggaggggttgagagaaagaaggcaaggcgggattagtggggaagaaaggactacagagccagtcagccatccccctccctggggcacaagaatcttctcccctaaagctcacctcttcaaacagcttctcattctccaacttgtagcatttcttgccgccagaactactgcttcctccagccccatggggctgggaggagccaggggcttctgcctggggtgaggccggattggggggtgggtgggagggccctggctgagcagctgcttcatcttcgtcatcatcatccagcacgatgatgctgttagcggtggccatgggggatcaaatcccccggaggaaggaagtgttggggatttcggaattcctgctggaaggggatggggcctcagaaagagcccctccagcatagcccctcccttcatctcacacattttccaatcttcttgggtttcagtaacacccagccctgctcaacagtgtcctcactgcctaacttcagcaaccactagtaccagacacttttctgacctttcactacctgaaaccacctgaaaaccttaagtccccacccccagctctaccccttctgtcgagatccagtttccccactatctctcatacttgccaagttgacttttccaatctctcgaccacctcctgcacgtgtgcactctggatttcctcgacattccctcgcacagataccacatccccgtcagcaccacctcaccagccttccccctttcgctctcaaacacgtcaaatccacaccctcatcccatcctgaaggatcacccccaactcctagactctcagaggcgaaggaggttctctcccaacaatccactcccgtttcccctcctgggattattctcacattccaccctctgacgggtctcctcaaaccgggacgttaggttggagagatctcacctcaagtcccctccctctcaccccacccgaattcccccattctctctctgtgacctgtaaccgattgtgagcccagtactgagctctccggattcctctcagatcccaaccccgcatccgaccccttcccccgaatgagcttcccgccaagtccccctcccccagttcagcccccggccgccccgttccccttcagggatggaaggaaggtaccacagctgcacctcagactcagcgcctgggactccccagtacctctccgtcgacattcccgcccctgccttcgctccccgcacggtccggcccccacctcagaaacggtctctcgaggcgaccctcgctgctgatctcagaacctcgcagggttccctccgccttccttcccccacccaccgcaggcccttctctggaccggaagtcgcggagtttccgcctacggacacctagacgcggccatattttcgtacggcgcccggcccccctgaggcaggaagtggcggtaggcccgcccccccgcccagtgccgcccacagagtatgccgctctctttcctatgaccagtagagggcgggcttgtccccgcaggacgtcccaaagtacctgggggccgccatcttgccgtacggtactggctacgcccgaactcgggggcgccaccgacggagctcttttcgcccggtgcttctgcgactccaccaatcagaaacttcctgcatccagcccaaccgccggcgggtcgcgtgctggaaggactgagccacctttccaagtaggggaggggaggacggaacaggacagctaaggaattgggccctccaagactgtgcaggggtgcataggagagcgagaatctcctaagagggaaaaaaaccctcttccttccgctgggccattgaccagccttccggcgccgctttcctacctgccaggtaccctttccgcggcttcatctactgcgcctgccctttcctttctgcaggctgcgcgctccccagccgctgtccagcagctacttctacttccccgtgcccacacctcccaatagtgaaatcataacacatgcatacaaacgagcacaattcgctacacaaatttgttattattattattactattgttattgacttcgttttaagcgcctccaaggaactaatgacccacccagcaggtgagacctaggtggttctccgttcctttctggtggggtgcccgaggtgcatgcagtgatgacctggaggccgtgccttgtccaggagctccagggccataggaccgcgatgtggggcgggggctttgaggagaatctgtgcaaattgccgctgttggatgaaatgagacttgtaaaataccttgagtctccactggtctcttcctcttcctctgggagagctgagaaaagaacggggagacaagaaactgactgacgccccctcgcccacacccgcacctcacccaactttaaagaggccggaaggactcgtggaggccacgttgggtccaaatacgagcttatggggaagtcacaccggttaacacggagattctcctcccctgcgtcacattccacaagtggtgagtatcttgccactttctaggaccacagagtaccagaacctcaaaccctcactgccattaaagaatcccacaccatatgtaagcctacagtcttcaaattagggaatacgaaaactccccaaaagggtacgcagacttaggagacataggaatttaatttacagattctcgactttcccaaaattgatctgagtaaatgcctgcaagtaaaggttttctttcttccggttcccttttataatagacttgctccctcttaaaaaaaaaaaaaaaatgcatgcaagcatacctccttttattgtgcttcacagatatgtgttttttacaaattgaagatttgcatcaagcaaatctatcagtactattttttccttttttcaagattttctttatttattcatgagagacacagagagagctgagacaggcagagggagaagcaagctccctttggggagctcaatgcgggactcagggtcaccacctgagccaaaggcagatgctcagccactgaggcgcccctaaagattttatttttaagtaatctctatacccaacatgggactcaaacttacaacccccaagatcgagagtcgcatgctctatcaactaagccagccaggcgcccttattggcatcctatttctagcagcatttgttcattttgtatgtctgtgtcacattttggtaagtattgcaatatttcaaacttcttcattacttttatatttgttaccgtgatctgtgatcagtggctttttggtgttactatagtcttagtttagggggaccacaaaaatgacacctatataagacagcgaacttaataaatactgtgtgttctgactgctccactgaccagctgtttccccatccctctccctctcgtcagctttccctattctttaagacattgacatattgaaattaggccaattaataaccctacaaagacctttaagtgttcaagtgaaaggaagagtcacctgtctctcactttaaatcaaaatctggaaatgagggatccctgggtggcgcagcggtttggcgcctgcctttggcccagggcgtgatcctggagacccgggatcgaatcccacatcggactcccggtgcatggagcctgcttctccctctgcctgtgtctctgcctctctctctctctctgtgactatcataaataaataaaaatttaaaaaaaattaaaaaaaaaatctggaaatgattaagcttggtgaggaaggcatgttgaaagcatgagataggctgaaagctaggcctcttgtgccaaaagtcaggatgtgagtgcgaaggaaaagttcttgaaggaaattaaaagtgcctctctggtgagcacatgaatgataagaaagaaaaacagccttattactgatatgggggaagcctgaatggtctggatagaagtcaaaccagcgacaacactcccttaagctacaacctgactctcagaggtcctaaggctaagagaggtgaggacgcttcagaagaaaagtttgaggcttgcagggttggttcatgaggtataaagaaagaagccatctttgtaacataaaagtgcaagatgaagcagcgggcactgatgtagaatatgtagcaagttatctagaagatctagccgaaataagtaatgaaagtggctacactaaacaacagattttcagtgtagatgaaacagtctcatattggaagaaggtactatctaggacttcaatagctagagagaagtcagtgccctggcttcaaagctccaaatgacaggctgactcttgttaagggctaatgcagctggtgacattaaattgaagccattgctcctttgccattccaaaaatcctagaggcctgaagaattatgctaaatcttctctgcctgtgctctataaatgaaacaccaaaacctggatgacagcacatctcttaacagcctggtttattgttaatgcctactgctcaaaaacaaagactcctttctgttagtgcttattaaaaatgcacctggtcatccaagggctctgataaaaatgtacaatgagattaatgttttcatgcttgctaacacagcacccattctgcagaccatggatcaaggaataattctgactttcaagggttattatttaagaaatacattccataaggctatcattggcatacataataattcttctaatggatctgggtgaggtaaattgaaaaccttcatgaaaggattcatcagtgtagatgccattaagaacattcatgatttatgggaagaggccaaaatatcaacattaataagagttttgagagagttgatttcaaccttcatggttgactttgaggggttcaagacgtcagtgatgtcagtgggggaagtaactccagatatggtagaaatagttagagaactagaatcagaagtgcagcctcaagatgggactgaattggctgtaatcttaagataaaacttcaagagatgaggagctgcttcttgtggatgagcaaagagagtgttttcttgagatgagatctactcctgatgaagatgctaagattattgaaatgacaacagaagacttagaatattacataaagttagcttataaggcagcagcagggtctgagaggattgactctaattttgaaagttcttctgtgggtaaagtcctatcaaacagcatcacatgctacagaaaaaataatttgtgaaaggagtagtcaattgatgtggcaaattgcattgttgtcttattttaagaaattgacacagccttcagcaaccactaccctgttcggtcagcagccaaaagcatctaggaaagacttttcaccagcaaaaagattaaaactccccaaacactcaaacgatgtttggcatcttttagcaataaagtttttttggttttttgttttgttttgttttgtttttgagagagagtgcatgcatgcgcatggggagggaaagagagggagagaatgccaagcaggctccacacccagtgcagagcccaatgcagggctccatctcatgaccctgagatcaaaacctgaacagaaatcaagagtcaaatgcttaactaactgagccacccagttgccccataataaagtatttttcaattaagatatgtatattgggttttttttgacataatgctatcacacacttaatagactacactatagtgtaaacatgacttttatatgtacggggaaatcaaaaatgttcctttgacttgttttattgcgatattcactttattgtggtcatctggaatcaaacatgcaaatttccaaaatatgcctgtaaatcatgaaatcttaccttgtcttaaatacagaaacatatagtggggcacctgggtggctcagtcggttaagcatctgactcttggtttcggctcaggtcatgaactcaggaccctgcgaccaagccctgcgtcgggctccctactcagcggggaatctgtttctccctctcccttttcccctccccgcagattatgctttctttctcactgtctctcaaataaatacatagaacctttaaaaaaatagcctatttctttcatcaaggtaccataagcaccacctttcctatctcattaaaaatgtacttctagggatccctgggcggcgcagcggtttagcgcctgcctttggcccagggcgcgatcctggagacccgggatcgagtcccacgtcgggcttctggtgcgtggagcccgcttctccctctgcctgtgtctctgcctctctctctctctgtgactatcataaatttaaaaaaaaaattaaaaaagtacttctaattttttaaaaagattttatttatttatttatgagagacacagaggcagagacacagcagagggagaagcaggctccctgcagggagcccaatgcggaactcatcccaggaccctgggatcataacaggaaccaaaggcagacactcaaccactgagccacccaggtgctcctaatttttaattattttaaaaatgtgtgcaatctttatgccatttaatcagttctgtccttataataattgtgatatggagaagttctaaaaaaaaaactgctgtccgtggtcacaagaaaggaaaatactttgcatttcagttaatatatatatatgtatatgcagggaagtatgatagattggtcaataaaagactttcacatataaaagcctaaaattgtctgtagggaagtggactgataataggtgtttgaggagaaaagattcatgaaagaaggaaaggaataatcccaattgttaagagcttgtttatctttaaaaaaaaaatgggtagtggtgactatccggtcactttgatattaccattcccctggacatttaaagggtaatatgttttatttttaaatgtaaatgttttgggggtgcctggctggctcagttggttaagtggctgccttccgctcgggtcatgatcccaaggtcctgggatcaagtcccacattgggctccctactcagtggggagcctgcttctccctctctctctgccgcacccccccacttgtgctttctctctctctgtcaaataaataaaatatttttaaaaagtgaatgtttttaatatgccagaaattacatccttgaaacaattttaatttatgatgaagatttttagatggctccttaaaaatatgcaagaagtacaaactttttcaaaattattttccagagtataggtgcaaaaaaatttaagacagctgttctaagctatccaagtgtcccctgcacagcccccagcagtcccatttccctcttgcctcccctctcacctctgtagcaggggaagagaatatttataggaaaggtggtcacaattccagctcctcctccttctgaggtgttctcaggagccagtccccaaactttgtccatggtagcagccacagcagcttacaaacagcctccagtgtcagtagtgtcaggatgagaaacaggaagacaaggaaggctttgtccaaggccctacggaagggactccttggaggacagggaccctgggcaaatgccaggaacacatcctcctcgtccacatcaccttcctcctcagccatactaactcatagtctgagagctgacaggatcagggaagactgggatggaagcccttgctcagcaaattgaggattaaggggcatggccacagcaagtcttacacctgctgagcctgaccctaattcccccaccaaagagagagaaaggagagagaagcctctgagcctttgaaatcatcatatgatcatccagtgcaatgtgaatggtccagactaaatgatacataaaggctgtccacctttactgtaactgtgacctgtcaactgaaggcccagctgagagctatgcaagctggtccagtcatgtcaggtccctaggctcagggcccagcgtcttgggcccctactgacaaagggtgaacaagaggagctagtatgagccggtaagccgctgtcagcccattccagctgtccaatgggaggtgagaaaaggcctaggggaactgaagcgggggtgcaagagcagcagcaggctccagcctgcacaggcctacctctccctaagtctgcagacccgttgaaacccaatgcactctcctcctcatttctgggccatgctgtccagaggacaactataattggagggcaggggcccaagggaacgtctgtaaaaagagaaagatagtgactggtcagcagagccggagagtaattaggacttaagtgttggggcaataatgagagcaggagttctgaggaagagttgctgactgggagtgtcatccaggagattgtcactggggcaagggttgaaggccatttcttgtccctgttgcccaggcactggccggaaagtccataacagaagtggaagcccagtggagacctgaggattcccccacccctgcgataagtggggcagggggtaggtagggcagccagcagaggaagcagtgtgtggtggtggacctcatacccggagcctttagggtctcttacttaccttaataggaagaccttgttcaccaccgaaaggtacaaatgatatcacaattttatgtagagtcaacttatgttattatttgctgttgccccaagagggctgtgttaagagtcaaaaaacctggatgggttcaaacaaattacttttgaggtatgttaaatttttgtttagtatatgtactggccaagtgaggacttatgttaaattaattcaacaaggaagccattagactgaggtggcactaatggcatggtggcctatattagcaaatcaaaacctaagcttgtaaattcctcaaggataggaaaccaaaacactgaggacagtcacagccatctaggcttttttttcttttttcaagattttatttatttatttttgagagacacagagagagacagagacataggcagagggagaagcaggttcctttcagggagcccaatgtgggggtcaatcccaggaccctgagatcacaaccccaggaacacacccggagcagaaggcagacgctcaaccattgagccacccaggtgatctgccatctaggctttaagctatatagccagtcaagtaattgcctttcttttcttctgtactttatctatataagtctgtccccatgctctgtctacagagcatgcctaagcacttctgatctgctgctgccccattcaaatttaaaaattcaaattttttaatttaaaaaaaaatatttacttatttgacagacagagaacacaagcagggggaggtgcagacagagagggagaagcaggctccctgctgagcagggagctccatagggctcaatccaggaccctggaatatgacctgagctgaagacagatgcttaaccaactgagccaccaaggtgcccctagttttttaaataaaattaataaatctctctcctcacagaattgttataaggagaaaatgacgtcagtttttttttttttaagattttatttatttatttattcatgagagacacagagagagaggcagagatacaggcagaggaagaagcaggctccatgcaggaagcctgatgtgggacttgatcccgggtctccaggatcatgccctgggctgaaggaggcgccaaaccgctgagccaccagagctgcccatgtaaggagttttttgtttgtttttactttttgtaaattgtgaagtgctatattaatatattaatttctgataccctcacttacatttcaggcaagtttacaataatgctacacaaacacctttatctttccttccacatggtaggttcagcaccaatgtcttgtatgatatataaacctagcacttcataggatttttttttaattttgaaataatttcaagtttacagaaaacatttaagaatggtttcaagaactctagtatgcaggggtgcatgggtggctcagtcagttaagtgttcgactcttgattgtggctcaggtcatgatctcagggtcatgtgattgagccccacaccagtctctgcatctcctggcacccctctcccccccacacactcacaggtgttctctctctctccaaaaaaaaaaaaaaaaatactggtatccttttcatcctacttccccacttgtctacatttgggtaaatttactcatttctctcaaccccaatataaccatctgttatgggttgcattttgacacacaaaatttgtatagtaaagtcttaaccctcagtatcttagaatgggaccttatttggaaatagggtgataatagatgtaattggataaattaacatgagtcatactgcaggagggtatatacctaatccaaagtgactaatgtcattatgaaaagaggaaatttggacacagacctgaatataatgagaacaccacgtgtgcatgaaggtagagagagggttgatgtgtctgcaagaccaggaatgccaaagcttgccagcaaaccaccagaagcttggtggagactcattggattagacttctctctcacattattgtttagaaagaaccaaccctgccaacaccatgatttcagacttccagcctttagaaccatgaggcagggatgctggatggctcagcagttgagcttctgcctttagctcaggccgtggaacctgggtctgggattgagtcccacatcaggctccttgcagggagcctgcctctccctctgcctatgtctctgcctctctctgtgtgtctctcatgaataaataaataaataaataaataaataaataaataaataataaaatctttaaaaaaacccatgaggcaataaatttctattgtttaagccactaagtttgtagtacttcattactaccctagtttgccctagcaaactaatacactattctaaataggaaatcagcaccactgttcaaatcctggataccattcaaatttcaccagctgtctcaataatatatctaataatataattctggccttttgggtccagaattacatattgcatctggttgtcacatatctacagtctcctttaatctgggcagatcctttatctgccttggctttccagaatcagttttaaagatcacaggctttgggtgcctggatgtggtttcagctcaggtcatgatctcagaatcatgagactgagcttcacattgaggtcagggctcagcatgaagtcgcttgagattctttcccctccctctccctttgcttctccatctgcccccctatctctctctctctctctctctctctctctctctctctctctcctctctccccccctatataataaataaataaaatcctttttaaaaaccccaaaactggggcagcccgggtggctcagcggtttagcgccgcctgcagcccacggcgtgatcctggagatccgggatcgagtcccacatcgggctctctgcatggtgcctctctctctctctgaataaattaaaaaaaaaattaaaaacaaaacaaaacaaaactgggatccctggatggctcagtgatttagagcctgccttcagcccagggtgtgatcctggatacccggaatcgggtcccgcgtcgggctcccggcatggagtctgcttctctcactgcctgtgtctgcctctctctcattctctctctctctctccccccccccgactctctctctctctctctctctctctctctgtctgtctctcatgaataaataaataaaatctttaaaataaaataaaaacccccaaactaaagagcacagggttttcatttctgcaaggtgtctctcaacccaggtgccacataagagcaagagaaatatgatgttgtgtcttttcagtgcaccagtgaattacatcaagaaatgcaagaaggagggatctctgtgtggtgcagcggtttggcgcctgccttttggcccagggcgcgatcctgtagacccgggatcgaatcccacatcgggctcccggttcatggagcctgcttctccctctgcctgtgtctctgcctctctctctctctctctctctctctctctttctctctctctctgtgtgactatcataaataataaacaaaaattaaaaaaaaattaaaaaaaaagaaatgcaggaagtgaatgcacctcactcctgtactaccaacccagtttagcaggtttctccttcataaagtcatcacttgtctgtctataattcctaagaatctgctacatcatcagatctctatctatttgccttagcatccattgataacccccattggaataatctccatgataatacttattaaatacttatttttaactccatcatttcctcttcagcttttagtcaacaatctactatgaaagagagcattcccttctccctcatttattcatttataatggattcctatcttactcaaatgaactaaaatccattactctcatatttattgtctggactgtggatttctattttacttaatgaattataatcagttactatcattattattttgatgtgcaaattatcccaaatttagctaatgaaatagcctttcaagctggatcctgtgtccttttgaaattttctcaacattatttgagtgcttccttactttctcgacaagaggttatccatgctctcaatctgtacttttgctgcttcagcccaagaatcagctatgtctttttctggcttcttcgaataagatggtacttggaaacccaaatctgggtggtggacgtcattattgctacagggatgccattgtttctaagcccttctgtaaaccaagctaggaaatatgtgaacatacacacacacacacacacacacacacacacactattccagttactactgctgcctaacatacccaaaacttagtggtataaaataaccattttataatgcttgtggaatgatgtcaggaattcaggaaggacacagtaagacagcttatctttgctcagtgatgtctatagagatcctcagctgggaagaccttaaggctgggggtaacttaactgctgaggtggaatcatgtggaggcatcttctgacagttcatgctagctgtcagctggatctctgctggagctcttggctggaacacccataggagtcctctccacagagcctgggcttcttcacaacatactaactttggggtagttagaattcttatatggccctcatggctccaaaaacaagtgttgcaatgaaaagggcagaagatgcatcaccttttagatctagcctcagaaagtgtacagcatgacttcattgcatcttatgcattacacgagagtcataaacctgttcatatttatagggaggagatacagatctcataaatccacctcttgatggaaacagtggagagagttcaagagagagaatggtaggtgagtaagaggagaacaagagcacagccagctctttcaaagaatgttgccctaaagggaagtagagaaatgcaggagatatataggagatatgggatcatgaggaaggatttttttaatgggtatattctggtatttttatctgcttataggaatgactaagtagggagggaggaaacaagggagtaaagtggtaattataggagtggtaatattcctgtccctggattttcttttcttttcttttcttttcttttcttttcttttcttttgttttcttttgttttcttttgttttcttttcttttctttcttttctttctttctttctttctttctttctttctttcttctttctttccttctttttcttatttctttctttctttccttctttctttctttctttttttctttcttctttcttttcttaagattttatttatttattcatgagacacagagacaaaggcagagacataggcagtgggagaagcagactccctgcagaaagcctgattcgggacttgatcccaggaccccagggtcacagcctgagccaaaggcagatgctcaaccactgagccactcaggtccctggtaggggtggtgtcctttagtgagagggctcagggttcagtgtgtaaatagaggagttggccttagaaagacacatttgtagtgcctggagggaagacagagtctaatggcagaaatgtagtgagtgagggagatgtagtgggaggtggagaaagttttcttctgttgcttctagtgaactaggaaataacataatcagttgggcaccaggggatagattcaccagggagagaaaagaaggtgtagacatttgcagggtcccagtgcaagagtaaaaatggaggcctacatatcataggtctaaatttttttaaagtcactaatcaggctaatggactgctaagtatgttctttactcataccttgacaaatgtaccttcattacaaaataaaaaaaatatgtaaaacaacacaattagaagaacaaaaaatgactacatttaattattatcacatgtccctaagtattctattggtggatcagatatagttggatgagtaataaagatatgcattatttacaaattaattatatatatattgttttaaatttatttatttatttatttatttatttatttatttatttgagagagagatggggggcgttaggggaggggcagaggggaagaaagagagaatctcaagcagactccccactgagtgcagatctcagtgcggggcttgatcttacaaccctgagatcatgacccaagctgaaaccaagagtcagacactcaattgactgagccaaccaggtacccctaaaatatatatgttataaaatgaattatatttatctttactttagcaaagtcactatgttattatagtcaagattttcacataatctgtgttctattgatggtaatgggctgaatttaaaagttaaatgcaaccatattcaaactttacagtatttgaatacatttgcatacagatgtataatgaagttaatgtcagattaaaattttgctcatgctttcaaatattatttttctaatgtttaaatcagctatccaaactaaagtataaaatcctggtgctggcacaaaaatgacacatagatcaatggaacagaatagaaaacccagaaataggagcacctgaatggcttggtcagtctgccttctgctggggttgggcttcctgctcaacagagagtctgcttctccctctccccacctcccaccccacttaattgtaccaagagcagtattactctttttgaagatctcatgtgccagtaattttatttttttaaagatgtatttattttagcccacacaagtgggtagagaggcagagggagaagaagagagtcctctccccagctgaggggaaagcctgacccagggctcatcccaggaccctgaaatcatgaccttagccaaaatcaaaggctggatgtttaaccagctgacccatccagaatgcgcataattttaaagggccacaatatactcagattttgctggtaagaatttctggattgcatgataaatctttccactgtttgtggggcctgaaaggaatattatcttccactgtatggctctggcttcttgatatcagttaggtgatatttttaagtcactgattttacctagatcatcttgacattccaacacaggagatacttgtttctcacatcctcagaaaactggaaataaatcatccacaggaactgcattgaagcaaacaacattcaaaataatgtgaatatccacatcgagggaaggagactgcatgatataatttctaaagcttatgagaacttggtggaggagattagcattgagtccataatcaacatccagtttccgactttctttaccattacaaaacttgtctaagaccttcctttatttcattcttgtccagagggcaggttagctcagccctgactctgctatctgcactggaccgtgaggtttcaaagtcagctgcatgaacagagacttgttctgggctttggggccttctgagacagaggagagtcagaggcaactgcacacattccccagaaccccatgaaggggttcaacttgggcacgaagggcaaaaaagttggctgctcagtggccagcccagcacaccaatgaagccgagcccacacagtgggggaaggacatcaaggagaatggctggagcagcctgggacttagcctggaaagtcacttctaagatcaagttataaaagacacgactttcatcttgctggcactctattgctggctttgatgaagtaagctgccgtgttggagaggcccacatggcaaaagattgagggtagcctctggacaatagccaataagaaactgatggcctgagtccaacaacctttaaggaactaaatcttgccaataactgttggagtgagcttaaaaacaggtcctttcctagatgagccttcagaatgtgcaggagctcaagccagaagcccttcttgtgtgggtataaaaacagtgctaggattagtccatcagacctcaagttttttgcttgcatgtttcctaaacacactttggaaaactatgtgaccttttcatatctttttcactttagagctaattgtttttcttgtgaatttaaataactacaaagggtataaaattctgatgtcttataaatgttgaaattttaacataaaactttatatattcttttaataatatcttttaaatgtatccaatagaatttaaatgccatcattgtttgatattcaacaatcacctttttttttaaagattttatttatttatttgagagagaaagagaaaaagagagagcatgagcaggggagcatgggactagtgactctggtatcatgacccaagcagaaggcagacacttaatccattgagccccccatctacccccaacatctcccttttaaaagagatatgagggacacctgggtggctcagtggttgagtgtctgcctttggctcagggtgtaatcccagggtttggggatcgagttccacattgagttccctgagaggagcccacttctccctctgcctatgtctctgcctctttctctgtgtctctcatgaataaataaacaaactttttaaaaaataaaaatgaaagagatatgaatgggggtgtgtggctgattcagcaggttgagcatgtggctcttgacctcagggtcatgagttcaagtcccactttgggcatggaacctacttaaaaaacctactgacttgccaagtaaagggtattaaagcataccctttaatgctcccctgctattttttttttaaaagatacgaatgaacccttcttccacagttagagatcttacgttagttttctccttgaattcctatttcattcacttccactacagaattttatcttattttaatggacgtgatatttgaaagtcttgtgatgatctccctatatttctctgcaatgaagtatattttttaaaattagttccttttaatttcttttaaccataacattctaaatgttttaatttgtcttctggattgaaccattagcagtagcactaatgtgatgaaaatcacattagtatattataaaatttgataattttataattatatttataaaatttgataattattaaatattaatataaaattataaaatataattatatttataaaatttgataattattaaatattaatataaaatgttatccaaaatgtatctcttaatgagttttcaactagttcatatatcattgaatcatattgctggaatgaggcagcattaattatcaatttcttttctattttttccttttcatcagagtaagggctgagggtttttgttcacataaataagtaaaagggaatggaaattgttttctttttttgaaattgttttattacagcaaatcactcacttctgagttacctgtcgaaaatcacataatgagctatcattaaaagtattttaatgatgatatttgagctaacaattcaattatattcttttttaattttgttgaaagcaaagaattggaaaccacctgacttgctaaaggactcattactcgatcattagagtcatttattttcaaaaacaatattccaaatattccaaattgtacttttgtttgacaacccagatgtttttacatttccccaccttgtaggcaatggtaaaaagaggaggaaagaaaagagaatctgtagaacagttctcaggcaaaccagttttaggaaaaaggacatatagcaatagagaatacaaaaatggatatcttcataactggccataccctcatacccctggtaaggtctttgtgtactccttgggttttgaacactctagggcaaagggccctggagtagggaagtgcaatatgatcgtcagccagcactgacgtctacttgaggtttatgataaattcaaagtgagatcagccagcatggatgtgtgattttcattccctctggatatgtttaaccacatgagtacagtggcggagctggcagatttagggctttgccaaaaatcctgggaaaggataaagtaacaaaggagtccaggctgtatgcaaaagtaacatcaggattattggtggaggccaggcaggaagatgagtaccaaaatttccagtttttgtattttgtgtttttttgttttttaactaaactctaccttcaatgtggggcttgaactcataatcccaaggtcaatatttgcatcctctgctgactgagccacccaggcacccctgaaatttccagatgttaaggatgagatctcctaggattataaagtgagaagagaagagggtccaagatcaagctttgggcagctccagtatttaatgtcaagataaagaaggcaatggtaaccaaaggcagagaggtgagaggggtatcagaaaagtgttaggtcacataggccaaaggacaaatgtcccaagaaagtggaagacaatttttcacctgctgctggaagccaaatatgaggaagtctgaaaagtccattggatttggttacatggaagtcattggagaatttaatagagtaagagggagaagcccaaccagagttaggttatgggaaatgagtgggaagcaggttatagaagcagtcaatactaacaattcttactgggatgtaaaaatgaggaggagaacagagttttattattctcttttatttgctttatatttattatattttataatatttatttgttggttctctcttttttatctattttcctcctttctcagaactggaatctaagctctatgagggcaggaacaaaccttgtcttgtcaagtctgtacagtatacaggatacgtggaaatattttttaaagattttatttatttattcatgagagacacacggaaagagagagagagaggcagagactcaggcagagggagaagcaggctccacgcagggagcccaatgtgtgacttgatgcctggactccgggatcacgccctgggctgaagacaggagctaaactgctgagccacccaggcatccctggaaatatttttttaatggattaatgaatgaaccaatgctaaataaaatatttacaaaagtagtccctcccaaaacaaaggtatatcttgatccaaggacaaattttagcttcatttctttgaatacaaaggcaattttaagctcttttcattaaatcctgagaagtagacattcaagtttatctctcctcatgtcccaaatctccctgaagtaaaggagtaaaaaaggcacaagcctacagggacaaagaagacaggagaaggcacgaatcagacaggagaagccagctttttaagaattggaaagctgatggagctgagagaagagtgttaactgactttgccaacctgggaaagcaaaaccctggggtaggagcaatagctgtaggtcacaagaaacaaggtgattcctgaggcagaacttggggaagatacaggaatagaggccccagttctctttgaaagcaaagggggaagatggatttaaaatttttgaagaagcagagttagttctccctgcagttgataaccaggcaccctcctaggccagtgcatcacactgggagaagactggagaaagacaaaccagatggattctggccttagagactccagacccaactgagagcagagatgagatgccaagcacaggggatgttagtgaggtctgtatcccaagcagtgaacccttcagctcccttttcccagccctccctagaggatggaaatctcctttcacaccatacaagtctaattctataaggaaactgaccccttggggatccctgggtggctcagtggtttggcgcctgcctttggcctagggcgtgatcctgaagtccctggatcaagtcccatgtcgggctccctgcatggagcctgcttctccctctctctctgcctgtgtctctgcttctctctctctctctctgtctatcataaataaataaataaataaataaataaataaataaatcttaaaaaaaaaaaaggggaaactgaccccttgaaggagaaatacctacagatattgacatttgggggttatttaaattctttaaaagtctgggttctcctgtaatgaaggctactagttcccaccaaggtagcagagtgacctaccagcttgttggtcgctccatcttaaatgtgagtgttcagttatttgaggaagaacctggacaagaacaacaaatcaaaattaaaaagtaaaaaagaaaaaataaaataaaataaaaataaaaagtaaaaaagatcataaagcaaacagagatataagaggaaaacttcacataaactgaaataagcttcctcattaaaaaaataagcttcctcatagataagagaagatagcatatatataaaagaacaggatgctataaaaaaatcaacaaagagctgtaagatccacagtagatgagaaagaaaaactcaagactaattttaagatccagattttactttttttatgacaagaagaagctcctggcatttgaaaagtaacagttgtggggctcctggctagctcagttgatggaacatgagactcttgatctcagggtcataaatgagttcaagccccacgtggggtgtagagattacttaaaaataaaatctttttaaaaacaaattaattttaaaaagtaacagttgtcctcattataattagctcaaacaacaaacaaaaagtgatttttgtcatttttcaagagaaaaaaagaggatttggtgctttaaagtgtgagctgctttgctctaagtcaaactctctctgctctattcttgccagaatgaatatttttctttctttccttctttctttctttctttctttctttctttctttctttctttctttctttctttctttccttccttccttccttccttccttccttccttccttccttccttccttccttccttcttctttctttctttctttctttctttctttctttctttctttctttctttctttctttctttctttcttctttctttcttctttctttctttctttctttttttttcttcttttcatcttagcaaaactcacttatatgcttgtgatcaggtgttggccagacagcattacttctggaggttggctgtgtgttcctgaggtgacaaagaggtgcctgggccccatatcttgtcatccagaagactagtttgagtttgactattgtcagggttccaagattagagcagaagtttacaaacaaggcttcctgaggcctaggctcagagctggcacaagattgcgtctaccttgttctgttgaccacagcaagtcacaaagccaatccagagtcaaggagtgcaaaaataaacacaagacaaatacaaggtcttgaatggagagtgcaagggagagagaaccagcaattgagggagtacacagactcataaacatcctgcaagagcaagagtcaatataaacatctgcctcagccagaggaaacccaaaccctttctggtctgtgctgggtaaataaagcattttctcccagacctccttgcaactagctttgatgagaaaggtggacactgagggagcctagaaagaaatgcatgaggaagaagccagccacattgtgcccatttcccacttcagctttccacatcaagccaggcttagctggcccagagaagaaacttaatttaaaatgaagttgggggggatccctgggtggcgcagcggtttggcgcctgcctttggcccagggcgcgatcctggagacccgggatcgagtcccacatcggtttcccggtgcacggaacctgcttctccctctgcctatgtctctgcctctctctctctctctctctctctctgtgactatcataaataaataaaaattaaaaaaaataaaataaaataaaataaaatgaagttgggggaaaaccctgggtggctcagcatttgagtgtctgccttggctcagggcatgatcctggggtcctgggattgagtcccacatcaggctccctgcaggcagcctgcttttccttctgcttatgtctctgcctgtctctctgtgtctctcatgaataaataaaatcttaaaaaaaaaaaaaaaagtaaaaagttacagattgtagtaagtgatgggagcaaaagaaacagtgtgagagagttagagagtggaaagacagggtgactgggaaagggctcccaaatatgacttcaagtagaatgaacctgtcttagcattacagcagaggaagtggcttgtgtgtaaagttccaaggcagaaaaaaccttggcatgttctagggcaatgctttctttcttttttaaccgtaatatatgggctacaaacaaaacaaaaaaatgaacaacccccccaccacacacacattttatttgtaatacagaacacagtcacatccaaaacaaaagtattgtgaaactctcctcttaaaatgctaaaatggagtctgatgtttaacatcaggtttactgagatatcatttacatgtaacacaattcactctttttaggttctgtgtgtgtttttttgtttttgtttttgtttttaagatttttatttattcatgagagacacacagagaggcagagacacaggcagagggagaagcaggctccatgcagggagcccgacctgggactcgatcccaggtctccagatcacaccctgggctgaaggcagtgctaaaacgctgagccaccagagctgccccaggttctgtgtgttttgataaatgtgttcacttacaccactacaatcaagctctagaacatttccatgttcctcaaaattccctcctgctgctttgtagtcaactcctccccacaaggtagagctactggcaagcaccggtctgatttctgacactacagatttttaaaaatagtttttctccatgtgtctgtctagaggtttattgatgttaatgatctttttgaaaaatctgctttgggtttcattgcttctctattgtttttctgtacaattttattgatttctgttctttcttacgtcattgtgcatttgctttggatttaatttactctttttttttctgtttttttttttttaagattttattcatttattcatgagagacacacagactgaggcagaaacagaggcagagggaaaagcaggctccctactggggagcctgatgcagaactcaatcccaggaccccagatcacgtcctgagcctgaggcagacgctcaaacactaagccacccaggcgtccctctttttctgatttcttaagacggaagattagattactgatttgaaatttttcttgttttctagtttaatgtttaaatttccatttaagtactggtttggcagtgtccacaaattttgataatgttgcatttcatttttattaaattaaaaatattctctgattttccttgtggcttcctctttgacccatgagttatttagaatttgcaaatattttgtagattttccaaacatcattctgttattgatttctaatttaattcagttgtgataagagaacatacttttttatgatttcaattagtttaaatttgatgaggcttatattatgacccagaacgtgatctattttgataaatattccatgtgtctttgaaaagaatgttgtttttctgttgttgagtggaatgttcccaaaatgtcagtaagatcaaattcactgatgttatgttcaggtttttatactctgctgattttctgtctagttgtcttatcaattactgagacaggaatgtcgaagtctccaactgtggacttatctattttgcctttcacttctagaagttttgctatatgtattttgaagctgtgttcagtgtatgaacatttaaggctgttatgttttcatgaattgattcctttgttgttaggtccctctctatccctggtaatattccttattttgaagtctaatttgtctggtattgatatagtccttctgctttctttggactgtgtctgtatagtacaccttcttgtatccttttattgttaacttaaatatgtctctgtgttggatgtgtttctagtagagagcatataatttgggtcttgcttttatttatgcaacatagttcaaaagtaaaataagtagtcaatagggtgagagaaaatattcacaatacatacagacaattaaaggccaatatgaaaatagataaagaatttccacaaattaataggaaaaaatcagaaaacacaatagaaaaatgaaaagcaggggaagtggcaggcagagggagagggagaagcgggcttctcgcagagcaaggaaccagatgcagggctcaatcccgggatcctagaatcataaactgagctgaaggcagacgcttaactgagtgagctacccaggggccccatattgctttctttttattccactttctgggagatgtcattgactttatcttccatatcttctttttcttttttcatctatcttcttttttgtctatctttcatatcatgtttttcatctctgctatcacactttttttttattttcaagagctttgttttgttctctgatcttattttttatagtcctctgtttttaattcatgcatcaaatttctttccttaactttcttaaagatattaataaaagatcttttggtaagttttctttagtctctgtttcctccaacttattttattttttgctttgtttgatctctgtatttcaagataggatttttccttcaatttctggtgatccttgactgcttatatttagaatggggcaccacaaagctgattagaagctctattcacgggcagcctgggtggctcagcagtttagcgctgccttgggccagggcatgatcctggagacctgggatcaagtcccttgtggggttccctgcatggagcctgcttctccctctgcctgtgtctgtgcctctgtgtgtgtctctcatgaataaataaataaaatctaaataaataaataaataaataaatattctattcattttgaatggagattttcaactttgatgtgattgtcttagtttgctttccctcaaaaaggacccccccacacacacacatcagacatgtattcaaatgaaagtattcagtggaaacacaggtaggggagcaaggaagtaagacaggggagagagggcagccataatgctagctatcactgagaataactaagccttaatcctatggagaaattgagaaaatgttgcaaaacccacacctcagaattattccaggcaagagtgagggagatgggatattcatacatcaaatcctgacagtcattggctgagagctgctgctgggggggaaagtattaattccctagcacttctggcctgccttatgcctaagcagagtagctttccttggctttggagagagatcacaagcagagactcagatgctggcacttggaagtcagcaagatacgctgaagtggggctgtccaggggacaaaggtgggggtagttgttaggttttcttttaatgaccggcggaggaaattaaagacagcagacccaggcggtgggttggagagcgctttaatggggagcgcttggggacgggttcccggacaggcccgagtcagggaagtcggcccaggcaaaccgcaggggggtttataaagagtttcggcgggaagaagggggttagggcggcattcggggaagagttacaggtctttgtaagccaagttaggatatggcggcaaggcggcattattgggaggttgcggccttcaatcggccattttgaggtccccagtctcgccagcccgtcagtagtgacctagctgggctattacttggttatattcatctgcacttttaggtcctttcttttgtccttgtcaggttttttttagacaatctcttgtctggagggttccagtctggttgccagagttctgtgagctaagtgggagaaaaggctgtgaatctcaactttcagtggagaactctaaactttcacttaatactcctgttttcggatggcacctttgctgtctggtgtcctccagtctagagactctctaattggtaagttctaggatataaattctcagacttttactagtttaggaggaggagtcacatgcctgctctcaaaagagaggtatttggggttcagctgctaagtggacttccaactaaaccttctgcttttagccccatactcacctccataggtgaccagtgtcactaattctttttgcagcttctgtgatgtaaatttggttgctgctctgctttccccagctttctctggtctactaaactagttaccactactttttagctttcaagtttccaacattttgttgctattgtctccttttctattctctttgctgtgtgattttggtcattaaaaagagttccttatcagaattcctcctgtgtccttttataatctactattttattacagatatttgtgacattttacctctaactgactgggagaacttcatttcagtaacttctcaaagagattatcacaaagttatttgagtaacagggcattctgattggctggtgaagatttctcccccttctattttctgcctttattgttttagaagcttgaagcactgattgaccttttgctatgtatctatgagagagagaaagggataaagtgatgtcttctcaccatcacaccagaccctggtacaaatttgagtgctagtggttagtaggtcccagttcattagtggaaggaactgtttcctgagaaatgtcagggactccagacacaagtcctactgctgtggggcttaatgtcccagtttgtcacaaaccccagcattaatgtggtactcaggattggctgatggcattctctgtaggatatcagttataataacagcgaagcttccttagcaactttgagaactatggtcactgaaccagaataggagaggaggaacacagcagatacttcctggtggctacagctgttgtttacaaacacatgtaaggcctcctgtgggcttatctacaaataccaagggaaggaactttctgcaggattggctatgcaagttgagacctatggtggcctgctgcactggtgacccctaatagatgactcccaatattcacaaccttgtgtagtcccctcttcttgaatctgtcgctggctcggtcacatgaatgtaaccaatagggtatagtatccactatgacccagttcagagcctaagcctaaagaaaccctggtggtttccatttttcctctcttggaaactttgggtctctaggtaagaagtctatctactgtgctggagagaccgggtggaaaggccacacagagagagaggggccctgagatttcacaataaagaacgaaggtcagccctggtggctcagtggttgagtgtctgccttcagcccagggtgtgatcctggagacctgggatcgtgtcccacattgggctccctgcatggagcctctctctctctctcataaataagtaaaatcttaaaaaaaaaaaaaaaaaaaaaaaaaaggaagaagaagaataagaatgaaggaaggaagccagcaacaatgagaattgaggcctgaaatgtatgactcccattgagcaattacagtcatcccctggccactcaagccctccaagctgagtcccaagacatgtgagggagggagcccttgtggaccttccagccccagcagacatcatgggagtcagaggcaagctatgacctgccagaattcctgatccattgcattgtgagaaacaataaaaacggttactgatttaagacaagtttggtacagtttgttatgcatcaatagataacccaactgaaccagaagaactctgggttcttgatgtttgagggactccctgtactcaccaaaaagatctgatgacatttagatgtgctcaaaaagagctaaacatacagggcagctaaaagcatagcctgatttggaagaaaatatgcattttagaatttttaaagcgctctaaaaaatggacctaggcaaccgttttctttacttcttgttaggcttcaaaaacccaacaagaatgggaaatgtcccaaacaccagtgccagattgtgtggctctttgacctgtcccagtatgagctccctctaatacgtgccaagggagctggggcctccctctccacttgtgatatatatatatatttttagcagtggcttaaatctgatgcctttagtttaaagccagattaagtaaactcactttcatacttgttttaaaaataaactcctgcaagaaagaaaatactcatctttatagaatcctccccctgtggtgctggcacattctctcaagaaataccttaaagtaaggaaaggaagatgaagttagaaatcacaggggatagggattgaatcctatttctttcatgttttagctgtgaggctttggagaagttacccaacctctgtctgtgttccctcatcattaaaaagtgagaatgctaatacccaccttaaaggattgctttgagaataaaatgaggtaatgtgtatgaaagtacataacatactgctggatgtatggttaagactcaaaaatatcttggttcactgtgctgcattcaaaggttattggagccagggttatgtctcatggtagtagaatgaggagccagagggctagtcagctcagtggcagtttggttgggtcaccatcactgccttctcttctctctattgccattgacatagatcctagagataatggatcttctttaaaatagtaaccagttaccctctacttcctgtaactcctgtccctattctcatcatagaaaacagagttctggttttatctcaaggaagaaatgataatagctaacaccaattataaatgagtcagatatttttttgctttggggttttaaaagccaaagactcatggcataagaaaacagttttgaaagaataattggaaagttgatttttcacaaaatggccacacatatgcatacacacatgcatacccacacactgacacatgtgggcatgcccacactcaaaggactggacaaaatttcactggacttcacaatagggaagtcaagcagagcagggagctagaataaatttcaccactgacttaaaaccttagaaactaatttatttatttatttatctatttatttataaaagattttgtttacttattcatgagagacacacacacacacacagagaggcagagacacaggcaaagggagaagcaggctccatgaagggggcccgacgtgggacccgggttcccaggttcacaccctggggcaaaagggcgctaaaccgctgggccaccggggctacccagaacttagaaactattaatgagtttttcactctgcccttagccagaaaatgacctcctctttatttggttatggcatcaatcttgtgaggaggttcggattgtttcagaaggaatgctaagagaagaaaaaaaaagggtgggtggctcaattggttgggcatttggctcttgatttttctcagatcatgatctcagggctttgggatcaagccccacacgtcttgggctctgtgcttattgggaagtctgcctctcctctctctctctaaaataaataaatgaatcttgttgggtgggtggggggaggaagagcacctgggaggctcagttggttaagcatctgattcttggttttggctcaaatcatgatctcctggttgtgagatcaagccctgttgggctctgtgttcagtgtgacatctggttggttcagactctctccttctcccttctccctctgctcctccctgctggcactcacatccaagtgctctccctctctctttctcaaataaatacataaataaaatatttttaaaaagaaaagagctaatatgcattattgaaattcaaaatttttcaacaaaacaatagtcttgaaaaccaagctctgtgagagagaaataattttctatattcacttagctaatatttgatgagatcaagacccaaacccagattcaaatttctaccaaaggaggggataacttagtctattgtctttggtttcctcatctacccatgatgctgataacacctacatcaaagaattgtttccaaaaggaacttctgtcttctaaagtggcaaccagagtcagcaagccaaggatatgatatggaaggaaaaaaagagaagcttgccctttcctgtcttggacattgaagaagatatctgggaggggagaatgagataagaatcaaagaggtttaacttggaattggggaaatggcttcagaaatacccagaaaatagaagaaatcactgaagttataataaactggtacccaatgtagataactgagcaaatcagggtgaactgtcagagagatagtgtctaatttgtactgtcagtccttccccaatgatgagcatttagttgagagtcaagggcctgccatgggccatggtggagtaggaggatggcaaaggaaatggaggcatatggtttggacagcttgggtcaggggctggatgggggacatagtggaaattcaaggggcccactgggctttgcagagctatagggaggttgagtcagccagagagatgagatcaggtctagccaagagagacatgtgagatactctaagtgctgactttagtcaaaggccggcagggtgaacatgaccaagcgcatattggcccataaaccaaaggacatactgaaagcatgagaaccccagttcccttcttatacccatccctgaggagatcacttaagcctcatctctctcttcatgcacccccaacagaaacttagcaagaagcctgggggcagggaagacgtctgagagatctgagactctgagcatttttatctagagagactgaaaagtatctgaacacccacttattctttggtattgcactgaaacaactccagcttttcatgctacctagtgaatgaaggttgtaagaaaaaccacattacttatagataaactatttctcctcacatctctgagttgtggtgtaagataattgatcctactaaagagcttagacattggtggggccctcaaaatggcctgcaatactcagtttttactgtgtaacaaacaactccaagctctcaatggcttacaataacaatcacctattttcatgcttttggtggtagaagttggctatggtttggcttatccatgttgggcttaacagagaatggtagaacttcaggctcctggttatgttcagttatttaacctgggccaagctaaaggggcagtggatatatagaatttgcttttctcttgacacatcacagaggtgtaagaggccaaatcaagtcacaaaagcacatttaaagtatctggttatatcatgtcatgacattccattggtccaagagagtcacataccaaagggcatgaatgtgtacttaaagaggaagcaaagtatggggaataacaatccaaaccatcacaggaccactgtcccctacctactctttcttccctcctcaaaacagcagtattcccaaattgatctaggaaatctaggagcaatatttcccttgagcaaagagtatcagtagaacatcacagaagaccccgaaagccagcacagcaagcatgatggggcagagtgaggaaagcctgggtcttggatgatagagttaaatgtgtgtttttgtttgttgttgtttttaaagattttatttatttattcatgagagacccagagaaagagagagagaggcagagacacaggcagagggagaagcaggctctatgcagggagccggatgtgggactcgatctcgggactccaagatcatgccctgggctgaagacaggtgctaaaccgcagagccacccagggatccccgagttgaatgtttttagcagacacctacttctagacttttgtaatacgaaacaatttgatgtgtttattgttagctgagttttttgtagatttcagttgagtacatccaactgatactggactcctattagccctatttttccataaggcctagagaagtaagtgcagaaggttggatttgaacccaagctttgtctgtagagcacatgcctttttttaccttactatgataccttactttccaagtcttgtgtggggctgacgcccctaatatacatggcagctgattcaaaggataatgcaattaaatgactccatggtgaaaaagcagaaagtctggtcatagcagtaaaaaatatcaacatggctttggtctggccctgtagccaaacaactcagagaagagccaggaccaggcaccagaggctactcaaatatagagctctactcagatgtagagtcctggggtttccctgagttttatgcaggagaggtgtcatgtgatggtgaccccactcaacaatttaatcaacctgcacatttaaaacaagctctctcaaactcctgctcccttcatcccctctgttcttttttgaaacaacaaaaaggaaatttggcaaatagcaggctaagccatcaatcttcaaatctattctatagatcaagatttctgggtcatgtggaaatagctgtctaggtagataccagggactgacccaacaattatatcccacacgggaggtgctcaggcaagtgtactgaatgaatgaacaaatcacaatctgggatttgtgatgatccttactgcaactctagagatctgttggccagtgtatttggtaattgaacctaaagggctaactgatgctagtcaaagtcatgtgagacatatcggctaggatacctaggatataatatctttccagggaatagatttctcatacctctgtccaaggcacttcctagtattgacatatagatgcagaataaacatgatagtcactgagcatgagtcagaggggtgaggacatggtgagtaagctttctctggctccccatagaagacattgagccacctctgcctcgagaagataggggaattttgtaagtgtaatctatttttggatacagttttgttacagagtgaaatatatgggcagcctaggtggctcagcggtttagtgccaccttcagcccagggcctgatcctggagacccgggatcgagtcccacctcgggctctctgcatggagcctgtatgggctctctccctctgcctgtgtctctgcctctctctctctcttctctgtctctcatgaataaataaataaaatattttaaaaaaagaaatatataatttaagttggtattttgagggactcttctttctattaagaaatctacttctttctaaggcccagtctcctgtctgtgagagtatctgcagagtcttccccaagaacctacatagcacttggctctcagatagcatgatgaatgcccagggttctagcagacctccagtgatgatggggtccctggtactgacacatctctgtcatcactatctttttatattgggcttctgcatagagggaccatgatgaggcatccacttccatctacaaccctctgctttcataattggggctatatggtctttcccagttcttatcttttacttgctctgaagtagaaggccttcatagggagctcaaatttgcccatatttaagaataacttggttcatattccattttgaggctatttcttttattcattcatgtaatcaaacagtcagcaaatattgatggccaattttgtgccatcagtgtgctaaccactggagtagtgcttaacaaaactgtaggtcccttcctctgtgcaacttgtggcccagctgaaaatatttacatttagtgagacattaacctcagttggttaagtgtctgtctttggctcaggtcatgatctcagggtcctgggaccgaggcttgagtcagtctccctgctcaatgaggagtctccttctccctctccttctgcccctccctcagatagttctctctctctctctctctctctctcgcgcgcgcgcgcgctgtctctctcaaataaataaataaataaataaataaataaataaataaataaatctttaaaaaagaaaaagtaaaaatgctccatgaaatggatacagagttataaccaacattaaaacaaaaacattaaaaaaaaaaaacatacattttcccagagaagagaaagagtatgtaagagtatactttcaaactatttggggatccctgggtggcgcagcggtttagcgcctgcctttggcccagggcgcgatcctggagacctgggatcgaatcccacgtcgggctcccggtgcacggagcctgcttctccctctgcctgtgtctctgcctctctctctctctctctgtatgactatcataaataaatttaaaaaaaaattaaaaaaaacacaaaaaactattctatggggtacctgggtggtgcagtcggttaagcatcttcctttggctcagggatccagtcctgtgtcagctccctgctcagtgggagcctgcttcttcctctccctctgcctctccccctgcttgtgtcttgagatctcctggcattgacatcaggttctctgctcagtgcagaatctgcttccccattctctccctctgcctactgcctccccccacccccacccctgcctcatatactctcgcgctctctctctaaaataaataagtaaatctttttttaaaaaaaggaatcaggaactcctgggtgactcagtcggttgagcatctgccttctgctcaggtcatgagccagggtcctgggatcaagccctgcatcgggttctctgttctaggagagcctccctcttcctctttttcccactcgtgctctctccatcgctatctcggttctgtctctcttaagtaaataaataaaatcttttttttttttttaagattttatccatttattcatgagagagagagagagaagcagagactcaggcagagggagaagcaggctccctgcaggaagccggatgcagaactcaatcccaggacccgggatcatgccctgagccaaagggaggggctcaaccactgagctatccaggcatccccaataaataaataaaatcttaaaaagaaaagaaaaggaatcacccaatatatgatcttttgtgtttggcttcctatttcagcatgttttcaaagttcatcaaagtagcatgtatcagtagtacattccttttttatggctgaaactatttcattctatgtatatatcataatttgtttattcatcagttgatggacacttaagttgtttctgcctttggctattataaataatgctgctataaacattcttgtacaattttctgtgtggacacatgcttttatttctcaggtaaaattgctggtttgtgtcaacataaacaaaactggaccctccttaaagtggtaaggacaaactttagtcagtaagatactgttgcagcagggaaaagaggccagcatgaatgaaactcaactttgatacagaggtaactgggcattgaaaaggggagtgagtggcaacttagtagagtggaaatgaaaaatttaaaaagcaggaatcccagtggtttggtccatgtgaaatccattcgagtttattaactggtgcttatccaagttaggctcctaccctcccacagaggctgggaggcaggggtgataaccttaggcgttggctaaacagtaagttcctttggcagccttgagttttctcaggtaggcacttaaaggaggggcaaggatcatcctagagctgtggccttgagctattagaaatgatgctggtattagtttaagtctttatagagctagatggaaagggcttagaggagcctggttggagtttggtcaaggagagaatcttttccagtcatatggtaactctgcatttaacttttgaaagagccctggttatcattgtgtgccttttgaaatacatgtgaatatattgctattccaaaaattaagctaataacaaaaggcacactataggagacatcatatataggcatataaccaagaagaatttatggagaacgccttcaaatcaatatgaaaaagacaataaatccaacacaaaaagtgaaaatggtacaaaagacaattcctcaaaggaaaaacaaaaactgccaattaaaataacaatgagataacattttacatccatcaaattaacaaagatgagtctggtaatagcaaatgttggtgactctatggggcaatagggacccttaaaaaaaaagattttattcatttatttgacagggagagaagaaagtacaagcagggggagcagcagaaggagagggagaagcagacttcctgatgagcagggagcccaaggtaggacttactgagccacccaggcaccctgatctgtggtatattcatataattgaatacaacagtggtgttctgttccccatggtagccacaagcgacatggggctacataaacttaaatttaaatatttaaattaattctatgttttaaatttcaaattttaaatttagttcctcaatcacattagttttatatcaattgttcagtgtggtaccatactggacagtgtagttatagaacatttccgtcattgcagaaagttctgttggacagcatgttatagagtagataaaatgagtcatccgggtctatatgtttcagaatatatgtttcaaaaatataatattgataggaaaaagccagcaagctgcctgtacacttagagtatcctctcatttgactggtttggaagaaattcataacatccattgccttcagagatgtgaagtgtgtggtgagggatgaagtggttggtagacttttcatatacatcctttgcctcttttaaattctgaaccatgcaattgtatcatctattcaaatataataaaataaattctggctccaaccaattcaagaaaaacacttaaggcatgtaaagcctttttggagtttggcaaaaccatatttactggttacttattgaaacctatccaccagattgtctaaaaaaataaccttgtgtttcctttctgtgatattttacaatttccacagaacgcaaaatttgaatattttcattgaaacttctacagcaagatcctgctcaatcttttgtatttgtttcacgtgaaactgagaaactgtgactaaaaaagttgtgaaagtactggtaagaaaaatgtaatgtgaacacaagacaaaactgtaatgtattagctaataaatatatccagtttgaacacattaaaatgctgtatattctcacagacacataaaaatacagtgatagtacaaaataattcatgggaatgataatgattcaggctggaggttacctctggggagagggaaggtatcaggaaggaggacacaggggcatcaattgactctacaacattttacttactaaaaaaaaggagggggggcaaattgttagtgtcggaaagggggtggtgattccgtggggtttcattattgccatgctgtgtggttttatctttcttttcttttctcttttcttttcttttctttcttttcctttcttttcttttcttttcttttcttttcttttctttcttctttctttctttcagattttacttacttattcatgagaaacgcagagacaggctgagacacaggcagagggagaagcaggctccctctggggagccccatgtgggacccatcccaggaccccaggatcatgacctgagctgacgcttaaccgctgagccccccaggcgtccctgttacttggttttctacttaagaatttcaatttgctcctccctctgcctatgtctctgcctctctctgtgtgtttctcatggataaataagtaaaatcttaaaaaaaaaaaaaaaaagaaagaaagaaagaaagaaagaaagaaagaaagaaagaaagaaagaaaggagaaagaaagagaaagagaaagaaagaaagaaagaaagagaaagaaaaaaagaaagaaagaaagagaaagaagaaagaagaaagaaagaaagaaagaaagaaaagaaagaaagaaagaaagaaagaaagaaagaaagaaagaaagaaaggaaggaagaaagaaagaagaaagaaagaaaatttcaacttggggcatctgccttggactcaggtcctgatcctacggtccccagaaggagcctggagcccgggtagggctccctgttcagcagagagtctgcttctccctttccctctgctcctccccacactagtggtttctctctagcaaataaataaatcttttttaagaaagaatgtcgggggatccctgggtggcgcagcggttggctcctgcctttggcccagggcgtgatcctggagatcagggattgaatcccacgtcaggctcccggtgcgtggatcctgctgttccctctgcctgtgtctctgcctctctctctctctctctctgtgtgactatcataaataaattaaaaaaaaaaaaaatgtcgggacgcctgggtcagcggttgagcgtctgccttcggctcaaggtgtgatcctgagtctggggatccagtccctcatgcggttccctgggaggagcctgcttctccctctgcctatgcctttgcttctctctttgtctctcatgaataaatacgcaaaatctttaaaaataaataaataaacataaaaatttttaaaagaatgtcatcttaaaaaataataatataaacaccttattaacaatcgctgatcatccctgtgggccagacacccagggcccaccatgagtcctgcgccacccctgagcctctcactctgactgatagggtgagcagtcatccttgcctccgggcctttcccgttgccgtcgcggttgcggagagtggagaggctggtgtcctctgtgaattgcacgcacacccgcctgcacagtccctgcagcaccttcctggtcctggtcagcttgatgggctgcaacagcttgtgtccacagtggcagcaccgtggtggtcagatggagagctccttattttgaaaaagaaagagatgggggaaaacatcattttaggctttaaaaaatgtgaaggcctggatgtgagagaacatcgtccatttttgaggaatttaaaaaagctttgcagctggatttgcccaggagaagtctggccacgtggacatgggcagcgcactggaccatttaagccatgatgacagaaatacacatgtaagcctgccttcttttttcaaagactttatttttaagtaatttctatacccagcatggggtttgaactcataactccaagatcaggagtcaccaggcactaactgagccagccaggcacccctgtaaaaggccttctttataaagaaaatataatgggcacctggtggtagagtcagcactgcatgatgttgggttgtgagttcaagccaaaggttggatgtagagattattaaaaataaactcttaaaaaagaaaagaaaatataagatcagatataaatttttctttgaaggatagaaacctgtttttatttattttattttttaaaagattttatttatttattcatgagagacagagacagagagagagccagagggagaagcagcctccatgcagggagcctgatgtgggactcgaccccaggtctccaggatcaggccctgggctgaaggcagtgctaaagcactgagccacctgggctgcctaggaaatctgtttttagttagcaaagggctcactaactggacttggaaaacttcaaaaagctaaatacaaatctcaaagtgaattcatttttgcattgcacttactgctctcaagactgtggcatccaaagggaagagaatgcgtatgattgtacatactgtgctgaggttgtcacatccatgatctcttgtttttgtcattgcctctgtatctgctcatctatctgtactcctcactggttgagaacttccaaaaaggcagggacgagtctgtcctgtctctgccgtgagcccagcatccagcacagtatgacacatgcacacagcccctgactccgtgccacaactgacctggcttcttgtgtttgttttaattgctgagtcaacagctttcttcttggtcgcttgttttatacttattagataaaccaaaagaactgttgagttggttttacaaacatgtgtagaggcatacatggctgaaattaaccacctaacaatagaacatgtctatgttcagagtccatcaatggttggggattttgaggtattttcaagtatggaaaactgactgacttagcatcttcatctccagcacatgcacattgtctcatgtgataattaaggagtgtgacggtcctcccaaatccatagtacatgtttgctgcaagagttaactgcaattttctggtctttatctccaaccctggctaagccaacacagtgtctccttgttgagtatcgattctccagaagttgctgtgctgcttggatttcattcatatactaagaaggttcataggtcttccttcttttgatgagattttccaaagactgctcctttacttcgatgtctagtaaggagagtgtgtgtgtgttgttcagtctattcttcttcactttgtcaaagaagctttctggtctccaagtgtctgtccaaaaaacaatagaaattttctctccacatttatacaactgtaaaccacagcagcctacagcatttattatggaagcattttgaataactcgataagagattcccagttttgttcctcccagaataagatcactgtgtattgtatccccaagtggattatcaaccatgaggaaagcaacatcattgatatcagcatccttcaaaatattatctgcttcttgttccacttcttccctatcagcaagaatcaattttcttccatgctcttccagggttttcttccctactgtcaagactaaggtataggcttccagatacacttgagtgcagcattttacagcttccaggcccttgaatgttgatgttcttggcatcacccaagcccaagctaaccaggtaacacatttcaaagtccagggggacagagaccaccaactgctccctttctgaagaagcagttaaggattggagtgcttcttacactgaatttgcatcctgcataaacatgaagcaagacaggggcacctgggtgactaattcggagactgccttcatctcaggtcatgatctcggggtcctgggactgagccccacatcaggctccctgctcagtgcggaatctgcctgttactctctttctgcctcttctccccctccctgctcatgctctctctttccccctctctctcaattaataaaatctttaaaaatatggagcaagacatttttaagtgtagtaacactctttcttcttttatgactaattttttctgaggagcactgatcaaagaaaggaaaatggctccttagacctactttgaagggtgtatcttccctgaatctttgacactgctttgcagagcgatagtggacctcactccagggagtgtctgtctcctgtgaagcctatatgtgaggagagagggtgtggtggtgtttagtgatgcctccttggcaattggagactgaagagggaggtctgctctacaggccgggatcatgagcattcaccctctttttatttaacaccttgcatttctcatcaaagaaatgacagtaaaatatagaaagccccatttctttcttctaacacaacctctaccctacttatgtgaccaaatatttcccagtctggatatgaaatcttccattatgagaaactctctaggatgtccattcaatatggtttgtagttgtggaattttgtgatccggacatatggtagaaaagagcattcttgtagcaatttgaattggaatctagatggtgcctggcctctgaaagtgccctccagcccagtgtcatatgagaattcatcccccatcccgctgcccctccaattccacatctgtgctgttagctgagtttggatagtccgtgagaacggggaagaatgagatggcaaaagagaatccagccgtctgtttgtagttaatgctgggtgctctcttatcactctgagaactggaaagttattgggagaataagtaccacatggactaaaaatctctattggtctttgggtagaaaaatgcaaacaggagttttgccatgttccccgtccaatctttctgtcctcaaaaacatctcaatgaatatcatggaggggagggggcagggatttaatcctccatccgggaaaacttttttttttaagatttaattacttatttgacagagagagagcacaaacagggggagcagcaggcagagggggagggagaaacaggcttcccactgttggtccttccaacagggacctcagatgcttggattcaggactcaatctcaggaccacgggatcatgacctgagcagaaggcagatggactgaaccacccaggcgcccatcagggaaaccttttttttttttttttttcagggaaacctttttaaaataacttttcatgcctaggtatcataaccatgttacatgacatttgaaaacatagtgaaaagttttgcatttttattatttttctttttcttaggcatgctctttttcttaaacacaattttgaatgtagtgtatatgcaagggggtgaacttcttcatgtacctaacaccctaaatgctttcctttgtggagaatccagatgtagtgatgtgtttttgaaagcaaatatgctatactttttttttttacttgaataactcacaaggaaggaagctagatttagaatctaacttggcaagataatatgtagatatggttaattataacaaaatcagcaaggtctcaaacttggtgttatcaatataaggtcaatgggcaaatgtaacttcatataacaaatatagttttaacttgaagtgaacacacatacttcgctatgacaaattcaattttctacaataaaagaaaacaaaaccttaaattttaggttataatttctggagttagaagtagcctatcagagaggctacctgattttatcccccttttatttatttattattttttaaaattttactttatttaaattcgattacttaacaaatagtgtatcattagtttcagaaatagtgttcagggcagccgggtggcccagcggtttagcgctaccttctgcccagggtgtgatcctggagcctcgggatcaagtcccacgttgtgttctctgcagggagcctgcttctccctctgcctgtgcctctgcctttctctcagtgtctgccataaataaataaataaataaataaataaataaataaataaataaataaataaagtgttcagtgattcatcagttgcatttaacacccagtgctcattacctcacataccctccttaaggaccatcacccattaccccatcccccacccatttcacttccagcaacctcctctttgtttcttatagttaagagtctcttacagtttgcctccctctctgatttcatcttattttatttttccctccttttcccaatgatcctctgttttgtttcttaaattccacattttcccactttttaaaatgacatgaaaaaaaaaaaacaagtaaaaaataaaatgaaatggtagctcctctttaactgcagacagagcatgcccaaaactaattttgtaaaagcttcttcccttggccagatgttggtccattgcaacctggagtctagcttgatatttattgtcttttttttttaatttttttaaaatttatttataatagtcacacagagagagaggcagagacacaggcagagggagaagcaggctccatgcaccgggagccccatgtgggattcgatcccgggtctccgggatcgcgccctgggccaaaggcaggcgccaaacagctgcgccacccagggatcccgatatttattgtctatagctatagctctacctgtatgtgcctgtacctaagccgcactgaaagacctcatgtcaacaaagtgcttttcttgcaacacttcccattagacatcactctcatttgtaactgatttgaaccaaggttgaattacaatcttttaaaatttataatttatttctatgccacacctgctactgtggagtgtttaaacggaatggcatttaaggtctgtttctccaattgactctaagttccctgaaggcggggctgtgtcagtttgggttcagggttgaatcacaggcaatagcacacatagaagatgcacggccccaatacgtgttctatctgaggtatacgtgttgttagaaatatatgcaaattaaatttacatcacataatatagttttgtcatcttctatttaataactatccactggtggaggggtacctggctggctcagtctatggagcatgcaactcttgatctcagggctgtgagttcaagccctatgttgggtatagagcctagttaaatttttattttatttttatttatttgaaagagcttctctgcactctttcccctagagcctgtagacaaggacccaggagtcacctcagtgctgtaatactctaggaaaaactggacgccttcctttccagaataaaccataagacctactcctctcctgacttcctgtggaaatgagtgggtcttctcctcacaggaccagtaactatatgtcttggttttgttaccaaataacatcctgggataaagggagaaaaactttgggggaaatcaatcacctctggctgggtcctctcagacccacagaagtagatccaacctttggaacctcagcttccggcctgtaaccacatctctactcctgccaagatggaagctgctttttctgaatgcttacttatctcatcgctcacagctgagatgagagcttcctctggaaatctttcttcagcgcctcacttctgagaaaggtgatctaatagcacttgtgttcctttcaccatatggtattgttgtggtattattgttgtctgcccctcactccaaaactggaagctctgagaggaaagagattatgtttgtcttcttcatcaaagcctagcacagtgcatggcatgagtgggcacttcagaaatgttgaatgaattgtacttgaaaactgaatgacctattaacatttttcataatagttttatttttttattttttataatagttttagaaataaaattcatcctttaaagtgtacaaatcaatggattttagcatagtcacagaattgttcaatcatcaccctactcttttcttttttaaagattttattgatttattcatgagacacacacacacacacagaggcagagacacaggcagagggagaagcaggctccatgcagggagcccaacgtgggactcaatcccaggaccccaggatcacgcccagggctgaaggtggcgctaaaccgctgagccaccgaggctgccccatcaccccactcttaagaccaaggggtctgaggatcaaggcaatgacaaccgattttgtgggagaaggtaacagaggcaaaatacctgtaagggtcagggcctaagtaacacactttccaggagagtgaacacaagaatttgctggggtagggtggggggatggagggtgacatctttcagacaatcaaggtaattttactgcacaccttgccgtctgtggagaggtctacaaagggctggggaagagaaaaggaaactgccagataagccagaaagagaagcagaggaggaaaagatgaaggtttcaggaatgtgatttccaaggtaagaaatcctcctcagtttgcaggaggaaatctctggggaagagtcaaggaccaccaagggtgatcccactcagcctgctcctgagatgagcagatgggtgagactctactaagactaggcttggagaactcttaatatcccccttggctcaatactaaggtcatggggagaagtgaaatctttacaatatcaagtctttctctgcaagcacacagtttatctttccattaatttagattttctttaatatctttcagtaaaactttatcattttatccacaaaggccggcatacctgttcaatttattaagtactttatatctttgttgctattgcaaatggtatattattaaaatgtttgtgcacaacatttaacaaagtgcacaaatcaagtatataccttggctttatatatgtatatgttcatgtaaccaaatgggaaatattttaaaaaatgtatttatttgagagagagaaggtgtggacctggggaaggcaggggtgggtggtgcaaagggggagggagagggggagagagagagaatcttgagcagactccccactgggcacagagctcaatgcagggctcaacctcaccaccctgagatgatgacctgagctgaaatcaagagttggacacaactgactgagtcatccaggcaccccttaagtgggaaatattattaaaagttataccttctgatggttgctgctgctagaattgcaatagatattgtatattgatttttgctatattgttttatatccagcaaccttgctaaacttaccaattctatcttaattttcttttggggttgctacacacacagtaatttcattcatgaatactgacgttccttagtttttttccttaatccttatatatttgttgctgttgtttattggactggctaaccttccactattgtattgactagggttattaagagcaagcatccttggcttgtttctcaactttttttttaagactttatttatttattcatgagagagagagagagagagagagagagagagaagcaggctccatgcagggagcccgacgcgggactcgatcctgggtctccaggatcgggccctgggctgaagttggcactaaacccctgagccacgcgggctgccccttgtttctcatcttaagagaaatgcttactattattgtgacgtgtgctgcaggatttttcaagatgtcctttatcaggttatggtgcattctttaacagcaacagatgttaaatattttgagtagtttttacatgccaattgacatgaataaactgttgcccctttaatgggtccatacttgtagtctaacgtttgtttttaactttgagtaatgtcttttgccgtaagtttcttctcagttctccctctttttttttttttttttaagatttatttatttattcatgagagacacagagagagagagagaggcagagacacaggaggagggagaagcaggctccatgccgggagcccgatcctgggactccaggatcatgcccaggccaaaggctggcgctaaaccgctgagccacccagggattccctcagttctccctctttacccatccattaagtgttggtcttatcaccatccccccccccccccccacaaaaaaaaaaaatcctctctcttttttttaagctcctggtttttgtaggtttcctaggctatcaaccgttgggggatgaccacccagttttcagacactgggtttttcaaatccccagtctgctccctccacaagcaggtttgaatttaagtcaaagcactggaataaggacgcctggctgaggttgagcatctgccttcagctcagggcgtgatcccagggaccctggatagatggagtcccacatagagctccctgcatggagcctgcttcttctgcctatgtctctgcctctctcggtctctcatgaataaattaaatcttaaaaagtaataataaaaaacctcccactggaatagaagatgggtggcttgattccagctctgtcgatctccaaaaatgcaccaagacagaactccccttcctttcagtctcatcaataaaatccctgtcccacctccaggttggttggaaactccgacgaataaatgcagtacaatcactgcaaattcctcgcaggtgaagggtttgatgtctttgacactaagattgttagaggttgtgtggggtaacatatagcttggattttgaagctgctggaatctagatccactcccgatcatgagtgtgaccttgtgcttggatacctaacctttctaagcctacctttgtccagcttgcagagaagggatgcaaaacactcgaccgtagtaagagctcaatgaatttagcgattattaagagataatgcacgtgcagacagcctgagaagcatagaaacttcctaaatgtaagcagtctgccgtccgtgggatggaggctccggagccctaaggcagctccagcaccggtaccggcgcccaggtaccgaggacatggggtgccgagggggactgcagggaaaacccctctgagcctcgaatccccactgtcgggcttccaggagcgccaagctgcacctcaagtccctaggtttggggggaaatgccaaaatgactggggagggggtagacgcggccactctcacgccaccggcgggctcctgctcccacttcccgggagctttagggacctcgcctccgcggcgaggcgccgagtcacgaaccctaatcgcacagacgcggccgggggtaacgggggtgctccccgccgcactcgctgggggcgggggctgccccgtcgcgtccctccccctaagcgagtcccgtgtgctctcgcgtgattcctttctcccagcgtccccgcccccaccccgctgagttcgcgcggcgccgtccgggaatgctctgacgtgacgtgctgcagccgggagccgagcggaagtgcagcccgaccccggctggaggcggggtgggcgagagaggtgggagggcagccggaagtgtgactaacctcctgcctcccgcgcgccggcgaagcaggaaggggaaggtgccggcctggcggggtgtggcctccagaggcagggggcgctgcgattggtctcggccgtggcgacggcgacgattggcccttgcgtgcggagggaggtgagaagggtggcgacggttggaattcaaaagtggcgggtgtggcgtcggtcgggagccccggagccccgcacacgcgtggcttgtgtcgcaagccggcgagagaacgcgggtcccggaagccccggcgccctgtcctcttccggcgggcgcccctggcgcgtgtgggccggtgctggccatggagccgcaggtgagtagggccgcgaggggtctcctgcccgcgacgctggcgagcccccggcccccggccggcctcggtcctgcctcgtggagagcagaggcccgtgcgtcctcgcgcaggggacaggcgggagggagagggctgggagcagccccggggcgtcggggtgcacgtctgccagccctccccgctctgattgatgtctccaggatttttcgatttcgaattctcgggcttatctgactctgtacccacctctccattcctgccagcgattgcagtgtgtgattgagaggagttctgagattccgtctccctcggggaagtggtgcctgaggccaaatccgcgctgatgatctttcctgttctctccggttgctgtcgcttcggagggcgggaaggggatagagggaatgcggtaatctgaactgaaggattcctcattctctctccttcgtcaggttttacagagatctctgcccctgggacttagtttcttctcttatcggtggccctactgcacttcacaaccatcagcagcctcccctctccagtcgagagagatgtgtgacagccagagtgtattgacttttggtgccagagaaatgctcctgcctggatcctctgtttgctagtatttcacattcagatttacccaaagcaggtttcagactgaagagatattgtttgtatcccgacagctaaagagcagatgagtatgatgtgaccgtgaaaaacagtagaagccttctcatatttactgagcacctactgtgtaccaggcacagtggtagatacttgggatgcagcaacaaacaagacaaatccctgtcgtccctacagatgccattctatgagaagctgccattctgtggggagccaggaaatataagttacataactctatttcaaagtgatgaatgctatgaacagaaggaaaaacttgagcagattaaggaagaggaggggaggccaacttgcaggatacagtattaaatagggtggtcttagtaagctccattatgaagatgaaagttgaataagtgctttgaacaagatgatggacaaaggctagtgattactgagggaagagcgttccaggcagagggaatctgctagagcaaagtccttcaagaattgtgtagcaaaagctaaaatggagtgagcaagggggcaaattgtgggaggggaagtcagagcatggagagtgggattgtcgaccccattgcttcttgttggggctttgttgtgaggcccttgacttttggatggttttaagcaggtaagatctgtcttacattttaagaggatcactctagctgccacactgagagtaaacatcaagggtaaggaaagaaacaaggaggactgttaggaaggaatacagcagtttttctcaacttccatactattgacatttttactgtaggggctgtcctatacatggtctgatggtagcagcattcctggcctctgcccactagatgtcagtagcaactcccacctaatcaatgtcaaactgtctccggacctcatcaaatgccccctagggagtcaaatcacccccagttgataaccagtggagaatgataacctgagaggtgatgctgacatggatcggggttgtagcagtggaagtagtaacatgtggtcagttctgtcatcctttgctgacattagatgtggtatgtaagagaatgagaagacttgggattttttggcttgaacaactgaaagatatatatcaactgggatggagaaagctgtaagaggaccaagttcgaaagggatttggacattagaaagtccatttggatgtaagtttgacacgtttattggacttccaagtggagacattgagaaggtagttgcatagaagttcaggaacaaggtctgggctagaggtataaatcttggagttgtcagcgtatggatgagagtgcactggaatgtggatagagaatagaaagaccatcattaaagtttggaaagatgaggaggacctgccgtgagagatggggaaaccaagagaggatggtctcctggaagctcaatgaagaaagtgtattaaggacgtgagagtgagcagctctatcaaatgctgtgataggtcaagaagcaggaagatgcagagttgacatagcaacacacaatgtacttgtgacctcaaggagagtagttttgatgacacagtgagagtgaaggcctgattgggatgagtttaggagagaatctggacatggtcaatattctagtgaacacttaagggttttgctgcagagagtaacaaaaagctgacaggtaaagcagagtcaagaaactcttttcagtttggaagaaataatagcatgtgttataatacagataggaatgatccagtagagtgaaaagttgatggtgtagaggagaaatggaaggattgataggattctttcccaatagatagatgaaggactggagtctgatgtatacatggaagggaagcatttctcttatgcttttcattgtggatagttgggagtcattgtgtctggctctatatcacagatgggaagagaattaatactgtactctttggagttgtccttaataaacaaacctttgaggggcacatgggtggctcagtggttgagcatctccttcggctcgggtgatcctggggtcttgggatcgagtcccacatcaggctccctacagggaacctgtctggaagggcagggattttgttcattacactcacctcaccttctagaacaatgtctggtccagagcagtcttgcaacaaatcttagtgcaacaaatccttattggatgaaggaagaaaggaatgatgaattttctctacctgtcatatccctcatcatctacttcttcacattgcttcacactacttttttggtacaaatctagtcttactactctcctaactaaaaaccaccatcagggtccctcttgccttcagtaaatgctagactccttatcatggcatactgcctgccatgcacactccatgtgtcagctgaacagaacaacttggcatccttgcatgcacccgtccttgctttctgcctgggaggctcctccttggcccaggtcccctggctaagtctttctcatcatccaggttttgcctaaaaagactttttagaggtgttctctgacactctccgcatctgaactacatgctcattccctccttggggtatactttttttatgataccactcagtaaaattttaataatctctttaaaaatgcttctctgcctctctctctctctctgtgactatcataaataaataaaaattgaaaaaaaaatattaaaaatgcttctcttctccattttccctgagtattttgagggcagggataacatctattattcccaaacccaaatcattttctggcatagtgagcactaagagtattgagtgaataaagtgagccaaagggcagagagactagccttggaattaaaagttaactatagtgaagattaaacattgatctgtatacatattactctcctgatggtcagataggagcagggtttgcataattaaggacctggttttagcatggaaaagttctctgtcctgagaaaccctttagtcctgggcaaattagaatagttggtcaccctagtcgagagtagccatggagtggacataatataatctctaagcaccaaattgcagtgcttaggagaggatctctcccactgcccccgcccaatacctgtactttggtggtacatgtgtcatgctgcttcttagttctcttcatgcaagtcggcctacttgtaactcttttttttttaaaaaagattttatttatttattcatgagagacgcacagagagagagagagaggcagaggcagagacacaagcagagggagagacagaggaagaagcaggctccatgcagggagtctgatgtgggactcaatcccgggtctccaggatcacgccctgggccaaaggcggcactaaactgctgagccacccaggctgacctaactctattttttttaagtaggctcttttgtatacttttcacatgcctgaccagaaactatatctggttctccacataaatgaggctaaagcctaaactcctttgcctggcattaaagacacgcatggcctccagaaccagactgtctagattttaaccgtggctctatcttttactcactgatgaacttagataagctattttacctctagatgccttccttcctcatctgtgaaataaggctaataatagcaccttctcagtgggctcctataaggattaagttgatacagatgaagcatttaaaacaatttctaaaatgttacccgcttgaggtgcccgggtggctcagttgagcatcaggctcttggtttcggctcaggtcatgattgatctcagggtcgtgagatcgagccccacatggggctcctgctgggtgtggagcctctcaaaataaataaataaataaaaataaaaataaaatgttacctgttcctcccatcatctagtcttcagccttacccattttccagtctctcccttaactgtgatcctacattctagctgaaagagcctgttgatttcccagccatatatcatgtgcatgtttgaagttttgccttctgaaaagagtgtccatttctctctgcctgtgtaggtactaccctgagagttagctgaggtccagcgtctgtccagctcttcccgtagagatttctccctcttttgcatcatgttgcacttctatctgtgccttttggctggtacataatccgtgggccccggtttgtacacgagaggtactcagtcagtacttgatggtggttgataattaggctagaacaggaaggggagttcttaggacttttgggctccaagggttgtctgaagggtctctcttttcccagcagaggtcccccttgttggaagtgagggggaacatagagctgaagagacccctggtcaaggctccttctcggctgcctctccctggaacaaggtttaagagggggcctgaccagatggaggatgccttagagcctgagaaggtaagctgggtttggaaagctttgcatgcacgtgtgtgtgtgtgtgtgtgtgtgtgtgtgtgtgagagagagagtgtgtctaagccagtgagagagactaaatggactccattcttgtctacctccagaaaaggacacgaggactggatacagtgactaaaattgccacatcccaatccagagcaccagccctcactgcaagaacacagacacaaaaccagatcacaggtgggctctatgaatgggcagaaaccaagggcatgaaagtccagcgctcttcaactcacttatttcttttctttcaattttagctaattttggataagtaataggtttcacttgtttcagaattacaaaggcacaaggggcgggctgggtggctcagtgggttaagcatccgactcttgatttcgcctcaagtcaagtctcccatctcatgagatggaaccctgtgtcaggctccacactgggtgtgtagcctgcttggggttctctctccccctctccctctgcccaccacccccaaattccaaacgcacaaaatgcattatacagtggaaagtttccctccgacccctgtctgccagccacccagttcccctccccagggacaactgccttgtcccttccagggccaatttatgaatgttcaagcaaatctggacatgttctccaacattttattattataagtggtagcatacttaacccagttctgctccctgctctttttgcttatcttggtccaacttactccttggtgtcttgagtaatttctggtcatgggagggatatctttagaagctggccagatttcagggatgagggaagttatcttatttctcaccctcagagaaagcaatctctctgcccctggcccagccagagctcatgccatcctgagactgattgttctacttttttctgctcccatctcccaacagctccaaaagttcccaagaagacaggaccccgatgttccacagcgattgccacgggtaatagtgcttcagagtgggggctgggaagagattcggagtatgtggaaagggagggtgatggaggtagaaggatactggtgctgtgattccttatgttcactctccaattctctagtgctgaagaatcagaaatcgggccctgctgttcctgcccagaagcctggaggtaggtgactgccataaccattgggtgagaggctaggagcgggaagagaagaggtggtgaggactcccctaaaaatctgtttgattccctccctgtctggaggggaaagagatgtagcatcaggtgtggaggctttaaaggctaggaggggggcagagagggaaagccacgacctccctgacctttgccctttctatgtccatctcagcagctgcccctccaatggtgggagggaggaaacccaccaagcgtccggcctgggacttaaagggtcagttgtgtgacctaaatgcagagctgaaatgctgccgtgagaggactcagacactggcccaggagaaccaacagctgcaggaccaactcagggaggcccaacaacaggccaaggcccggggggcagagtgtaggacactggaaggggagttggccagggtgcaggcccaggctgagcagggccagcaggagttggggagcctcagggcccgtgtcctggaattggaagagcagcagtgcacacaggagggcttgttgcgagagctccagaaagaacagttagaattgcaggaggagcggaggggactggctgcccggctggaggagcaggaggtaagggccatcgtctcagcaaacgccagcccacctttctgggttaccctgaagtctctgggggttgggagtccctgaccacctctccagcagtattcctctgtccttctgtcctctgtccttctccacccctgctcactcctgtatcttgctttctgccccacttctccctactagatggaattacttgtcatttatcaaatgatttaatcatctgtttggggcagtttgcatatgcacttccctctttgtggaatgttccttccattctctgtctttttgttggcgtattcctatacttttgggtatcattgtccttgtgccccttttggctctttccatagcactccctaatctgggaccctggttcctattttcttacctctttccctggcagactcagtccctggggacagggaccaccctaccgccaccaccccacatcatcgtgacttgtccttactcctcagtgtctcactctctctgtccattctgttccggacagaggcggttgcaggcatcagaagcagctctgtcgggcagccaagcagaggtggcatctctgcgccaggaggccacaagccaggcggccctcctggtggagcaaggagaacgtctccacgggctagagatggagcgccggcgactacacaaccagctacaggaactcaaaggcaacatccgcgtgttctgccgggtccgccctgtccttccaggggagcccaccccaccccctggctacctcctgtttccctctggccctggcgggcccgctgatctgcccacacgcctcagcgtttcccggtgtgatgagcgccgtgggaccctgagtggggcgccagcccctgccacccgccacgacttctcctttgaccgggtattccccccagggagtgggcaggatgaagtgtttgaggagattgccatgcttgtccagtcagccctggacggctacccagtatgcatctttgcctatggccagacaggcagtggcaagaccttcacaatggagggtgggcctgggagagacccccaggtggagggcctgatccctcgggccctgcggcacctcttctccgtggcccaggagctgggcggccagggctggacctacagctttgtggcaagctacgtggagatctataatgagactgtccgagacctgctggccactgggccccggaagggccagggcggggagtgtgagatccgccgggcagggcctgggagtgaggagcttactgtcaccaatgcccgatacgttcctgtctcctgtgagaaggaggtaaggactgagggcctctggggctggagaacggggaagagcggatggagggggcacaaggtgcaggtggatggaaaaggaacaggagagagtgggaggatggaggaagggcaggttgcgtgggtgggtggtcacatcagttttggcctatgggccacaggataaatttgtctgcctttgggaacgagggggtagagtggtgcatgtggccgaaggcttcctggcccccacccaccgcatctcaggcctcattcctactatagctctagccgctctgctgtctccaggcactgaagctgtccctggccatcttgtctaagattgcaaccctcaccctaccttcacacactcgttactttgctttattctcctccttggtactctcagacacaccgtgcattttacttagtcattttgcctcttcagtggctagaaagaaagcttagggtgctctggttccttgctactgacatagctgtctgctgattcccagcctgcttttgccctttgctacccccaccccaggtggaggccctgctccatctggcccaccagaaccgggcagtggcccgcacgtcccagaatgagcgatcatctcgtagtcacagcgtgttccagctgcagatctctggggagcacaccggacgaggcctgcagtgtggggcctccctcaaccttgtggacctggctggtagtgagcggctagaccccagcttagcccttggccctggggagcgggaacgccttcgggaaacacaagccattaacagcagcttgtccaccctggggctggtcatcatggccttgagcaacaaggtaggaatggggatgagggccagtgggacctggggtaggttggggtgctcctatcctaatcacctatgtccttcaaccctctaggagtcccatattccttaccggaacagcaaactcacctacctgctgcagaactctctgggtggcagcgctaagatgtgagtgaaagggacagacagaaggggttggctggagactgtgaggctgggatcaggggtgggaaaggggaaatagtgggaacctggtgcaggctccacccagccactgatgttggggtttggctcccacttctctctctacaggctcatgttcgtgaacatttctcccctagaagagaacgtctctgagtccctcaactccctacgctttgcctccaaggtgcagttaccaccaggcccaggccctgtcaggactcctggatgcttgtaggcttctccattctgaccctttagggatccattcagtcctttaggccaagggcacattcatctggaaaggattcacatttgccgggcatctgggacactacctctctgaatccatttttagctattgggttttggggtttttattttttaaaaataggtagttaagaggtcaaaactgtataaaagctatgcacaacatggaagttttaccatctcccgtgtgtaccccattctccctacctgtcctggtagaggcagtcatttttgtcatttatcattttacttatcctttcagtgtttcttcttgcaaatagaagcaacatgcatattattcccttacctcttatatagaagacatctattttttcatatatgtatgttgttctgtactttgttttgctaaacagacattcctgggattactctcccaccagcacacagagattaccccattattttgatgtctgcctaggactccgctgtgtggctgcaccaaagtttatccaccagttccctctactggacacttgggttgtttccactcttttctctattacaaacaaggccacgttgactaaccttatacatagatgtcattttgtatttgttcagttatagctatctagggagattcctggaaatgggattgctggatcataagagacttggatacgggcgcctgggtggctcagttggttaagcgcccgactcttgattatggttcaggtcatgatcttggggtcatgaggtcaagccccacatcgcatggagcccgcttaagattctctcttcctccccttctaccctctgctcctcatgtgcacacattctctctctcaaaaaaaaaaaaaaaaaaaaaaaagtttttcagaccattccgagtagagtgaatccagattccaagacccacttaaacattaaatagaaggccatgccatgaattctctaggagacttatgctcctttcagtaaagtttctttactgtctgtctctggagggtgatttttttctctggctgctcctttccaaagggatagccctatgatgggttctggctttatttaggatctctgggcaggtgtgcccttctgctatattcaggtcttctccccaataagcattggttgctgccatagaagtggtccattccctaggtaccctgccctgattttctgctttgatcaggatttcccttgctatcttgcaagttcaattaaagttatagcaacgtcattaacagccaacaccataaactctttagtatccttaaattactatgttattacattttacctgattgtatcagaaatgtctttaacatattaggtttgtcccaattgggatcaaagcaagggccacccatttcattttaattcttttattttttaaaatttcttttaatccgtaataatctcacctccttttatgtctttttgttgttgttgttgttgttgaagaaatagggtcatttgtcttatagaaaataccatattctggattttggtcagttgcttcctcctccttccatactttttgttatctagtagtacacttaagggcttggatttgaatttgatttgaatcaggcttatttcttgacaagaaaacttgaaacggtacagtacacttcattgcatcagaagtcacctaatatctaatagctttactttttttttttttttagaattgctttacttttttttttttttttttaatttatttatgatagtcacacagagagagagagagaggcagagacacaggcagagggagaagcaggctccatgcaccgggagcccgacgtgggattcgatcccgggtctccaggatcgcgccctgggccaaaggcaggcgccaaaccgctgcgccacccagggatccctagaattgctttactcttaaatgaattaaaaatcatcagatttgggtgttaccagcttgtgaccatttgaaaactccctgttgacctaatgatttcacttagtgatttttggaataatgatcgtacctagatttgttacttcatcaaggagtttaattttctcagtaactttacatttattagtcttgtctcttctacaaagaatttttcccttgccatttatttggttactctgaaatctagtctatgtagcagcaaaggcaggataaatgtaggattctttttttttttttttttttttaagattttatttatttattcatgagagacagagacaagcagagggagaagcaggcctcatgcagggaggcttgatcccaggtctccaagatcacatcctgggccaaaggcaggcgctaaaccgctgagccacccagtgatgcctgtaggattctttatcaattttcagtattagaagttgatgtcttggcaacttccaaaggtgaccaagtgagttttggtttgggaggtgtcattttgcagatgcttattgatttgatatatatcctttatagtcattattccttctgatgttcagattgccccgtcattggccaatgggagctcctttaagttggctcctgtgtcctttagacaggacccagtagtctttattctagactcatcttgtacctatcctgcgtagacttgggatcatttattttccaaggagcctttgttcttaaaggagtgttgttctatctaacttattaacaactaaatggtaggaaggcttggggtgtccgggccatggtattgctggaaatggaggctccatctatctctgctcctgtgtgtggcttctatcccttctcaggcctcttcacttcctccagtcctggtgtggttagtgggcatagacctaaccttaactgagaccaggctgaatctgccttcagagcctttgttttagtattttctgagggcagccccaatattgggggtggggggtgatcttggagaaaactgttattttggttactcacaaaatatttttattctaaaacctctgcccgcaggtgaaccagtgtgttattggtacggcccaggctaacaggaaatgaagacagatccagatcctctgtttgggaagggggggtgggggtggcgctgaaggatgctttgttggggggaggggcgctctgtgacctgggtctatcaaataaagaacaagttttttttctttaaataaaggttttgttaacaatggcccgtatctgtaaaaatgggaactgtggatcgtctactctgccgagtatttgtgttttgcagagcaagggtttcagcttttctctacctggctatctcctggagactagatggttaccctggttgtccgcctctaggagatgtgcccactggccgaccgccgtcactggtttgccgcaggccacccagctccacgcggagagctcgtctggtgggtgcgggaaagtggaagcccgagtccagaggccgggccagcgagccctcctgcaaactgcgggctctccctcccgctctttccttgccgtcccattcgaagaactggggccggcccgcccgctgcccattggctggctctcggcggcgttaccgcctcgctactagctctcccggtccgtgtacccgccctacaggcgctgggtgggctgcacgcccgctgactcgctcgcgccaaccgccaacggccaccgcccggcaaaggaggggctcggtccacccaggtgccgcgcgcgggaggggtcacgcatgcgcagaagcgcggcggcggtgtggcggggggagacttaccacggggagggcggggccggggcaaaggcgggaggaaggcggggcactcgagggaggagggcgtggcgggggcgacgggacgggtgaatggggggcggggtcgtgaactggggccgaggggcgggacttggagtgaccatggaggttgggggggcagttaacggatgtggcatggggcgggggccaggctggagaccagctgcggggaagggggggattccctgctgccccgagggcggatctccctccgaggaaggggctgcagggattccctctcgcactgggtcttgactttccacccgccccagccgtggggaggccgccacccgttcggcgccctccaggcccgttggaggtgagggaggtggggtgaggtggtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctccctccctccatcttcccgcagctctctgcgctgcgctgttgggtgtggtctacgcccagagtgcaggacgagggctggcctgggacccccggcccttgcctgcccgccctccgacgcccagacgtgccctccccgcgcggggggttcgcctcggtctcccacgtctgcctctgcccggctcccggcggccccagctgtcactggtaaggaggcggcgggaggcgcccgtgggggggggcagggagccgggggtcggcgcgcagggcgcgggcgggagagcctcgccgcccaggcatcagctcgcgctgggctgactcaagtcccctctcggactcgctgtcctggggagtagagaccgggactgggacacgcccccctcccagggcactcaaggaagttatctaacccgggggacagggagccccgtatttgagggtgacctgccataacctggcatcgggattattgttctggagacacaggggcccggggaggcagccgtttctaatttggaaaacatttccagaaaagctcccaaaacacattctctgggtagcagaacaccccaattacagtatctctaaacagaaggtgacagtagaaactgaatggtaacctttgcttctgcaaccatcattcctcctaaaatctcaaggccaggatacagtatcccaggggagctctggaagctgggaaactagagaactaggttggggggtggggggtgttagggagaggagagccagtcaccagagttggaaaagctggagtcatgaagcttgggaggggtgctgtgtgatttcctatccaggtatttcatatttggagactggtagcacagctgcttgagtccttgaggcatagaaaaatggggacagtttctcaacattcataaccttctcccatcccacttctggatagcccccccccccaggatgcaatggcacagcccccccggctgagccgctctggtgcccccccactttgggacccagcctcccctgctcccacctcaggccccaggcctcgactttgggagggtcaagatgtgctggccaggtggacggatggactgctatacttggggaccatcaagaaagtaagacctttgacttctgacttattaccttccccccattctccttatgtagttccgattcctgtttcatctcctgtgctcatccattccaggtggacagttcccgggaggtgtgtctggtccagtttgaggacgattcccagtttctggttctatggaaagacattagccctggtgagaccttagaggcccaaatatatgcatgctgtggaaagcagaaacctggcttgggggatgtaaagggggcttaaggacaggccccacaacactgttccctcacagctgccctccccggggaggaactcctctgctgtgtctgtcgctctgagactgtggtccctggaaaccggctggtcagctgtgagaagtgtcgccacggtgagagggcaggatacctaaatggtctagcttgccctgaaccttccaggctgcctctaagtcttccctccaccactgatccttaggccacctgtcctggctgagtccccaagccactgctctggccagtctgctcaactctgtaacctctcttccagcacagggagaaatagccatggaatcaggaggtgtgggctttgtagacagaggatggttcaaatacacctttactaaccataaaaccttgggcaaattcccaagcccctaggagcctgtctcctcacctgtaaaataagggtaacttatctactgcagccagatcacagtcaaagatgaaatgaggtggcccagactcctcctatcccagtcactagcacacacaggtatattgtgcaataaatggtctaccatcaatattatcattattcagcttatcaccaggactgccacgttccaagagccccagcccctggagagggagagggcacatcctgggtctgtcgccagtgtgtctttgccattgccaccaaggtaaggtcaccattctgtgggagcctcccccaccacctctcccaagccttcctgttccctacccgtctgaggtggcctgtttcctccctgcagagggggggtgcactgaagaagggcccctatgcccgggccatgctgggcatgaagctgtcactgccatatggactaaaggggctagactgggacgctggacatctgagcaaccgacagcagagctactgttactgtggtggccctggggagtgagtaaatgagggacaggggtggaggagtggtggggagggaatgaatgatggagtgggtggggggatcctggggaatgaaggagaaaaaataggatgaagggagtgctgaagaaagcagaagtaggtggtgagtagggtttggggccattcaggtcggggcagtgtctggaggtcaccagtcctgtgttccctctcaggtggaacctgaaaatgttgcagtgccagagctgcctgcagtggttccatgaggcctgcacccagtgtctgagcaagccgctcctctacggggacaggtgagatggggctggctctctgggagccaagggagaatactcttgccctgctctaccctctcaggcccccatgctgcttcagctccatgtctccccagcctctgaagctcacctcccctacgcaccccatccttattcataagtcctccacgctctctccccctcgcccacttccaggttctacgagttcgaatgctgtgtgtgtcggggtggccctgagaaggtcaggaggctacagcttcgctggtgagtgggcaccacctccacatggctcctctctcagcacccccagcctcccaccttgggctctccaggcttttgtattgacaaatcattatttctccagggtggatgtggcccatctcgtcctctatcacctcagcgtttgctgtaagaaaaaatactttgattttgaccgcgagatcctccccttcacctctgagaattgggacagtttgctcctcggggaggtaaggggtattgaggctttgggggtgagagtggaacagggaaggatggagaaagggagaagggagagggactacttctcccctgatcccattctcctttcccagctctcagacacccccaagggagaacgttcttccaaactcctctctgctctcaacagccacaaagaccggtgagttggaaagaggttcagaaagaaatgcagacgcaaatatggaagcctgggagggaaggggctgcgactcacctggaagatcatctctgaaaaagattgaataatagcatcagaggggccctttattatggcactgaccctatatcatttcttttctcaccccagtttcatttcagggagggagattaagaagaggaaatgcttgtttggtctccatgctcggatccctccccctgtggagccccttactggagacagagcccccaccaggtcactggtccagggaggatggggaagttctcagggtattaatggagggaggcatatgtatggatatggggaggtctttggggtgtccgggagggggctggggggataaggaggcctcttacagcttcccttcagggcagggccctgggggaggggtctcacgtcccctggggaagcgccggaggccggagccagagcccctgaggaggaggcagaaggggaaaatggaggagctggggccaccctcagcagtgcgcaatcagcccgagcccccggagcaaagggagcgggctcgtctgcagagggcactgcaggtacaggggcaggggcacccccgtggagccaaatggtggtgtgggaaggaatcaaggattccctctcagtcctttgctccttcttctaggcctcagtgtctccaccatcccccagccctaaccagagttaccagggcagcagcggctacaacttccggcccacagacgcccgctgcctgcccaggtcagtgctccttcctcattccaagcagatgcatgtacccttagaatctctccttcgattgtctacatcttctggactttcttacccagaattattgtccgtctcccacttggctacccacttcttgtcctagagatacttccagaaccaatgtctggatctctagtgttctggggatggggattccttggggctgtttgagctttgctcttcttcgtgggagaggatcctgttcccctgcttcgggtcctgactttccccctccctaaacccagcagtcccatccggatgttcgcttccttccacccctctgccagcaccgcagggacctctggggatggtgaacccccagacaggtgagattctacccctttacctgtgccacccctcttcacctgtgtgctcttaagttcctcagtctctaatgtgatatcttggtgcctctgattcacatgtcagctccgtttttggtccatccttatcagcatctggactcacgattgccttctctccctaggtcacccctggaacttcacattggtttccccacagacatccctaaaagtgccccccactcgatgactgcctcatcttcctcagtcccagccccctccccaggtcttcctagacgctctgcacccccttctcccctgtgccgtagtttgtctcctgggactgggggaggagtccgaggtggggttggttacctatcccgaggggaccctgtccgggtccttgctcggagagtacggcctgatggttctgtgcagtacctggttgagtggggaggtgggggcatcttctgaacagcctgcctctgcctacttccccattcacacacaccggcactttcataccctgacctctgacctcacctacagctgggatgtacctggggaggtagggggatagttctccctactgcccaggctggaatccaggtgaggggtctggggaagaggctctctcttctctattcccttcccgattcctgacccttcctccatccctcttcctatttcctttgatgttattttgttacagctttttaaatattttttaaaattatttaacccctggggacggagactgaggagggggggaatgataaggggtcccagactctgtatgattgaaataaaggtaaataaacaaatctagcagccctgggtcattctggaagatgagaacaccagggactagaagcacttctaatcttcccagccaaattcacatatgtgacaaggaaaaaggcagagtgaactacagacaggatttattaggggcccagtcatcacctggaagtcaagggcattgaagtatatgagaggaacatggcagagacagggttcatcacggtagggctgtgctggagtctgaaactgactctgtaacctggcgcacccaatgcaggtatggggagttcccctgctccacaggcaatgcaatcacttcagccacttcataagggtgcacagaactgtggaaaaatgggaggggatcactcaaaagatatacctaaaggagcccccaccccgagaccacccagcaagtgcccgacccccacaccgtcatggctacccacgtcaaaattctcaccgaatgaaatctgtcaaagctggaaccaaggaactttgggttttaatcatctaagaggcaaagataaacatgactgaatcaaggagtggggttgattccaggatatcagatgagggagagggatgagagtcagggaattgaggtttcatcggatgggaaaatgtttctcaccatcagcacctcattgtcttcctcaatctttcctttccactcatagctgaaaaggttagggagagtgtttagggagcaaagattgtcctcaaggaaaagtactgcccataagcccctaaaattaggttaaccccccaactcctgactcacatggatgtaatctgagggatgaggttaacgcaggctgccagccgcttctccaccacagccctgaaggtgaagacaaagcctcattcagaacgccctatgacctgactttctgcactggcagcccagagacagggttccaaagcccgagatcaggcaggaagctagggagcgcactctttcccacccccaaccctctccgtcatgatcctccttcctggctccacactgaggccccccacctggcgatctccttggcgaccttctcgttggggcaggtgacaaaggctgcagagacagagccgggaacatagccggagcttgaagccggcgaaggctgggacggggggcttcctgaagccatggacagcagagctcggggtagcaaaagcaggcgggaggccacaggcaacagcgccggcatccaaaggagagacaggagcagagcggcctgagagcacgaaatgaacctggtgtcaccccacaagtacccgaggaagtcgcatctcgggaacccttcccttgaatagacaggcctgcccaccctcttctgcacaccgaaggaaaaggtccctgaagctggaagagaaacttggttaactaaggcagactcggctttcgctcccccctcaggagccaacctctagggttttgggtgagggcggtggtcgaggcttcgaggaccggaaggggcggggccggtcactcacccctccgccgagcaggattgcgggagcccgccctcccctcatgcagcctacgctggcagggagttgaataccaaaaaccgcacggaacgccgagaagggaccccagacccaggaagagcggcctcttcttacctgggcagcacccacgtgataagaaaaccgcacacaccacgtgacagtagaagccggccccgaacccccagagcccgccaatcctggccctcacagggcccggtttgccccgcctcctgctgggggaggagcgaaagggaatttggccaatcggcagctggatctgcagacgtgcacggaaatggcacgcgcgtttccgagtaaaccggaaacagccaattgcggcctgaggagagccgcagcggcgttccactgtcacgtgagggggccggtcgtcttcaggcggccgtgcctcaatgagctgcgcgaggaggccaatcacaggccagccccgcaggccacgtgacgagagacctggcgctagaaaagggggctggagaccccgccgactagatgcgtcaggttgtggcgtggggagtcgtccttaacccccagagtgtgcccagttacagcccctgcgctgttcccgaggccttaaagagtgggcgggtctgagaagatcgaagctcaggggtggagagcgccccctgcctctttggccaggacgacacatgccgggttgggtggtgaaccacgataatctgaggagccagctggccctgggcaggggacagtgattaggcagggatgggcaatgcaagacgatggtcaggtgggaaagatgcattttaaaaggacagtgagaccctgtaagtgggataaagggtgatgaaaatggggctgagggcaattcagccttcctaattgaaaccccaaaggaggagacagactggtgaaggggggagccgaggagagagagggcttcgggttggggttatggaggacacaaggaagcagtgatagtccttttgtcccttactctccctcctatttaactctcccggactagtgtacctctgagtcttgggtctccttcccttaacccatccccctaggagccaggacctgtcctacataacttccctggggcccaagcacatccagtgacccaaaaatggagagaggggccaatgagaggagagaccggtgggagggaggcagcagaggaaagcctcttgccactccccctacccagtattccccctcctttcaagttttggggtctccacctgctgggtgggtgtgactgggtgttgatcagagttctctcatagctgcatctctgaggatggggtcttcctgaactctgtctttgggtttggagtttctgagctagatctctgtagggcctttcagtatttgcagtgggatctttttccagaccaagtttcctttttgttttgggagtttctgtgtttctgggagcttgatgactctttctcgaggtctttcaaactctttatgagcttgggggtctctgcatttaacatctctgagctacatgaatatctctccctgcccctctgccttctccccatcctcaaaccccaggtctggagtttctctgtctctttcttgagttatcagtctcggagtctgcagtttcttttctctgcgatttaagtctggggtctggtatctctctggatctgagtcccctaagaactaattctagctctgtttttttctgaatctggatctcatctttttctttgactctaggtctctgatcttggttcctgaaatcactgtctgattctagagtctaagacttctgtggctgtggagaacctttttgaaactggacactcatattttgacctctgacccttccctcaatgggggacccggggtcttttttttttttttttttttctctgagatcagagtctcttttcctctagatttcaggttttgtgcctcagattaatccccacccctggggtgggcaacaagatatctgtggtctggggtctgtcagtctcgggatctgaggtctacatctttagaactgtactctctctcagtctggtgtgtgtttgagtcaggggtctctctctctggttctcactcagtaggggtgggggccgcagagtctctctctcctcctcctcctgctctctcctctcttgctcgctcccccgccccccccctctctcccgggtgccgctgctgccgttggctcctattctcctcctcctcctcctctctcctcctctccggtcgtatccggtcctaaatactccatatctcccacaccttcctctagaacgtttttttaaattgtgtggcatttacagaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttggggtggggggggggggagcagagccggggccagggaggggagcagctgaaatggagggagagagaggaccgggaaggctgggatgggagcagtggggaaggagagattggaggccagagggtaggggtagctaggggccgtaggcgccaggaaacaggctttgaagggggctgaggggaaaatgatgaagaggaaatagatcgccagaaatggtgggaagagagaaggctagggttgggggaagagctgcagaaataatttggaggtaggagctgagagatgaggaaaatattaaggaaataggaggacagagtcttaggagaggggctaggagggagaaatgaaaacataggggtgaaaaaagcaaagaagatggggggtagaatacggtggaagggctcagaggatggtagggggttgaagaagagaggaggatggagggaaagaagaaggggccagatggagagagagggaggcagtggggggtgggggaaatggagggtccagatggagggaagagaggagagagggaatgggctgggggaggatagaccagggcagggggagggccaaattatgtgtgtgtttattgaggggggagggggcaatagaagtaagatttgagtgatggaagtagaggacaggttaggaccctgtcctagactctgaccctccttaaggcctttgagcagtgaaatgtatcccctggggtcctatccgctcccttcacttcaccacttttacccccctcccccacctccagtccctattaccattcccccctccctcctctggtgtccctcacctatatctttccccccatatggtgtccgttccttatatgagtccccctctgtccttccctcatatcagtcctttctctggtccattctctctccctctgttctatctggtagctcccttatatctctaccacctcttcacctgtccttcatgatccccttgtctaaatacccctgttaggtgcacctcgtttcctctgccccatgtccagttgggctcttctcgtatattcccttgtccccaggaatttactctcatttctgcgttcttttctctgaaatctatccctgtgatttgtctcccaggccatcctctgtccctgcctcactccccatcttgtcactgcaaatctatgcctacccactttcccctaacacctcagctcttaccacccattcctcttttcttgtctcctctacttcctggggtgttggagatttgggtgcaaagaggcaggttttgatggttggaacagggcctacaaggcatccccatctgatccctgtgggacttcttatcctagtaaatttttccctttcctcagctgtgttggtctgtctcttgcatctgcctctcagaatcatccttacttaagtctagacagtatgtgtgtgtggggtgtatgtctccagagtggcttctaagctaagatccctgtatccttccctgctccccaggaggaaggtatcccctgaactctaacctgcctccctgtggttgcagcctgaaccagcccctccaagaattattagatatatcaacagatttctcctctgggagtcctcagagtctgagtgcagtgggcatgttgcctgcagtgtgtgcagtctcagagcccagggactggtgatctctgtatctggcgggtatcagatggaatctctgagatggctctaagatggtgaaagtctcaaagtgttggggtttctgaagattgtatgctaggggttcatctctgactcttatttgcagtttgggtaaatttgaagaacacgtttgtagacagaaaggggctagacttttcaaaaagtttcctgttcaacgtattcagttacagtgaagtttaagggccaagttattttcctgcactgtactcatgattatcttgtaaaggtgacagaatttgattcttcttcctctaaattgtttctcactctgataccttaaacccatttttttttttttaatttatgatagtcacagagagagagagaggtagagacataggcagagggagaagcaggctccgtgcaccgggagcccgacgtggaatttgatcccgggtctccaggatcgcgccctgggccaaaggcaggcactaaaccgctgcgccacccagggatcccttagacccattttctatccctttaatgtcaccaatttgatttccttctcacttccataaggcctgttgttccctgtgatggtgtgtggcattgggatttaaaagagagacagtttgcagggataggggattgggaagaacagctaaattgggtaagatgcccctgggggcacctctgagcatgggcaacgcttggtctactgttcttttctagaagtttgtctgcatccccagcttgagcttttggaggccccctctccatcccaggcctggatcttcctttcttccttccccttttttcctcaagctcctcactgtgccttggagaggttcctcacctgtggagttggctttcatcctgtctatggagactaagtgaagagagggggcagtatagaatctctgatctctgggcatggagtgagagaagagattgattcagtctctgttccttcaaacaaaggcatatttcctacctcctcactctctagccgtgcccccctatagccagatgttgacaagacctatccttcccctaccatcagaagaaccagaactttccctagaggttgagcagggttgggctaggggaggaaagagctgagaatagaggggaggcagaagaggccctctcctgtctctgactctgaacaggtcatctccctcccttcctctcttttccagatgtttagctctcagaatttcaagaccaaatattcctacacccctaccccatccttctttctcacagctgtgtagctttttccactcagttttacagctgggggagccaccttccctccaagtccttatcttctgcagttgtctagatgccctccctcttccctgtcccctgccaccaccatctgtgtgtgcttttcttctgccagttctgctgtaccctcaatcttttcattttttggacatggatggagatcttgactatctttctctgcctctgaatgtgtaccctctgtgtcatgatataattcccctcctggagcacccctctgtatttctttcctcaagtctgcagagccccctgtgatgtgatttcccctcctctccttccccccagacatacaggcttatcttctgttcccttaaaataagttaccatgtgcttcccccccatctgtgatctcagggcgggtggggtctcctactcccactttgtggactcttttcttgccattttgggcctctgtctcctaagtgcatagaacctcccttaccgtttctgtgtgtctctgtcccctagatgttcggggaccccctatgcatcgaacccaatacgttcattccccatatgatcgtcctggttggaacccacggttctgcatcatctcggggaaccagcttctcatgctggatgaggatgaggtgagcagagtgggaaggctggggaaagacctctgggtagcatggagaatgtagagagaaagataaggaaaggtttcattagcgaaggggtgagagacacagagaaggcaaaaagagaaacatttgcaagcggtctgaggaggatggccactgagattgagatttggattggggtgtgcaaaagtgcgggcattctctcaccttggccaggggatctttcagggccatgtgcagtgttggggaggagatgtggttctgaagacttaggggtggctcctgttgtagctctgcccagattatgggataggttaggacaggaaatagaaacaaggcctgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagagagaccagttgggctttcaccaggcacatcaatggggggtctgggatataagggaagaggtgcctggggaatgaggggaactggaagtaggggacattttctgaagaacttcaagtggaagttggcagggactagtcagagtgtgggagctggggcccaggcagagctgttagagtgggggtggggggtgggggggtggcgggggggttccaattgggcactgggtcagcagcagaggactcatcagaggaaacagagggtacagatatgaaaggtagatgcccagattcagggagtgggggtgatttgggtaacctgctttagagagtgataggtagccttggagacaggtgaggtcatgagagatgtgcttctgatcctgttggggagggtgtggtgaggcagggctagaatcagagttggggttaaccagggtttggaggcacctgagagccaaaggagagtgtagagaggctggttagagcttccaggtcacagagtgaaatccaggtgtctaggggaggacatgatgactttaaaggcagaggtggttcaaaagtcccaagttttaggcattgaggggcatttgagtgattcactagtggttgtaggtcttgaccaaaggttggagtctgtaggatgaactgggggaactggaaccaataagagtggggattgttgtaaggatgagggtggggtaatgaaggaatgagagctgggcacaggtctgagtgggaatggtgggggtggatggggaggtgagcagtgtgtagaaccacacggggctggaagtgggtaggctgtggatctggggctaggggctagcaaggtggggtggttcttgtccagctggagaagattggaggattggaactggggatgaggctcagggagagggaatggctcaagagaaggaggcaagtgactgtggttgagtggggggcaagggaaggagatgaagggtggggggaggtgaccgggccctctgaggggagcggggaggttgggtcccagtctggccgaaagccgggccgtgggagggagacaagctgtagatcctgattataaatgcagcttctgctacccccatgacaggcacggagggagggaaggtggtgagggaggtgggaggttgggagagaagcggggacaatggaggaactgaaggtcaaggggaaaggggattaccagagtagcagactcccccggggttgcgggcatagctgagtcggcttcgggagaatttcccggaggggttttcaaaagaaatggaggaaagaggagggtgggacgggagggaaacgagggagagagactgggagagagtggggagaaagaaaccgactcatcccgagacacttggagtgtgtgcaggggccggggccaaaggtgggcaggcccggggggagaggaaagggaggttcccatttctcggtgggaaagggagaggcgaaggccggccggggccggtgaggtctgacacacccccgcatcccgtagatacacccccttctgatccgggaccggaggagcgagtccagtcgcaacaaactgctgagacgcacggtctccgtgccagtggaggggcggccccacggcgagcatggtacggcggccgagcaggctctcgtgccctggacagtcgcggggacagggctggaggtggacggggctgcaggggaggggtgggggtcgggaaaaagagagctgtctaggggtgggaggaggaggaggaggaggaggaggagacgacgacacagtctctcatcccgcgagtgggagcctggaaggagaaggcgccctcttcggggatctggagcgggaccggggttgtgggtgagaggccccagtggtctttgctctgtttcgctccccttttcctctccagcagtgaagtttgcctgttttcccggtacttataaaaatagtctccttagatctttagcttcccgtcccagcgttcctgcccctgcccctcccagcccttggtctgggatcgtggagagaatgacctagttcctgcccttcccctccccctcagacctttgcccaacccccacgctcccaattcctcttccagccagaccttctggcctgtgggccctccttcttttcttgcccccttttccctcttctcttcagctgcttctattttctgcagtcctgttcccccccccttctctttcctccccaatttctcttattttccccacccctcctgatttcctctttcggacccctcctggtcccggtggaacttcatcagaccccccatcatctcctttctgtctgtctgtggagctatctgctcagtctgtctctccaactctctccctctctccatctgtctcttcccctccctccctctttctgcccccccttctacccccctctttagtcatttaaaaaaagatttttgtcttcctgagaagttcgcttaaaaggtttccatgggaacagtgaggagagatgaaggcagagaacagagatctgcagccaaggtgcagagagatgccctcggcccccagaaacccccttgtcactgccatttaccactgcatttcccttccaggactagggatccagttcctctattcccccaacccctggtgacccctttcttccaccagcaacccctcccctcaggaatccagtatcccagtttctcttcctccaagagatccagtggccttagctccctatatatagccctcttctgataggcccaggtctcattgcccttgggggccagctctgggaccttgggtgggtgggtgggtgggcagggatgtgtgtcattgtcatggaaacctctgaccatgggggtgtgcagatagcacatttctgtgaagcaaaaccagggtggtggtggtggtggtggtggtagtggtgtgtacagagaatgcgtgtgatgtctgtcacatctgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccatgctcctgtcgaccttgtgtcaacgacatgagtccccggggacccagttcctcaaaggcacacttgggcagtcagccgtgtgcaagctagtcctgtttcatagggcctcggtttgatacctgccaaggagggtgctgggcgggccacttgcctatattgatacatgtcgcgtctgaccctgagcttgcatgtccctgcgtagggctcatctccagtcagtatcctagtgtgtagggatgtgtggctgcatgaacaggatttttctctgtccctggtggcagctgtgtgtctttgcatgtgttccatcattggcctgggtatctgtgtcaatcccagcacgggtgtccagggcgtgtctggatgtgggtggtgtgcgagtgggggaagggagtgaatgtgtgtgagtgggtttcttggaatcctactatgtgtggaacacctttgggctgggcaggtgtgagcccctcatctgtctgggagagggggaagaaaagctgaaaaggaaaggagcagggagaaagtagaaaagtggggagaaaggaggtgacgaggaatgagggaggcttggctaggatagaaggactagctggagaatgggaatgtaggagatatttaagccagattgaggagaagagagcttaagatggggaactggatggaaatggagagagaaggggtctgggagctggggaggtggcgtggggagagcagaaaggcctgttcataagctatctcttgagagaagaaaaggggcaaaatgagagggcactggctggtgtagattgtataagatcaggcttagctggatgagggatggccactcaggcatagaggctggctcacggtgaggcctgtcaccacagggactgacattagagtttcctgtcctcagcacagagttttgtccccccacccccctgtttctctgctctgtccaactctgttcctcatcctgctctggcagcctccctccttggctctcctcaagagctgccagctgggtatgacaaggaagaaaggctgaaggaaaggttagggatttggcggattggagggcagggggagatttctgtgggtgatggcaagattagacaggttggagaggtgggagtccaagcccttgctgtgtgtgtgagagtgcaattgtgtgtgtacacagggtgtgtacatgtgtgggtgtgtgcacaatgcctgtgttacgggtgtgtgtaggtggctgttatgtgtgtgcatgtgtgtatacattgtgcagggataggatcacagtgtaaacttaccaggtttgcttgtatgtatacatgggtttgtgctgtgtttctgtacatgtcactgaatgcagcatcaataacagaatgtcctgtgtttctgtcatcctctactttctttcccgtgctagtgaaagtctttgtaaccatatgtgtatgtggcctccatgtacctgtgacttatgtgtgagctcctggatcttagttcctggtaacatgtaaggttatgttacttccaagaaccaagtaaaccagttagcaaatttgttctctttctgtccattctttagttccaaagcaaaattttagtggatttgaagtttgtctctgtgcccttattaggggagcttgcatatgagaagtggctgagtttggttctttggaatgggggtgaggcagccatacctgagaaaggcagaaactaagaaaaagacttgctaaccccttagatgcattgtttagtgtgtcctagaagggtaattgatgcatttactcattttttccttcttgggagagcaatcatgggtgcaggcgtcagagtcagagaagggctgggggagaagaagggatcgtgatggagtggatatggtcatacttttcatgtgaatgaagaatgtttgtgcttttggggtaccaggataccttgctgtgattgggatcatggtatattcaaacatgtagcttagagattaaactggcttgtcgtgcgtgtgtgtgtgtgtgtgtgtgtgtgtgtgagggttaggtgtccatttctgtaatgtgctgcccacatgattgcccaagggactggggccacatgtccacaccagcaggtgtctgggtccaaatgtgtactcccctgttgcagtgttcacatatgtctaagcatatcccgtgggggtatgtgggcctcaaggtctcagaatgtggatctgtggcactcccctgctcacagttgtctgtatgtctcataagcacctagatctctatttttttgtattgtggttatatacacgtacccccacagttcagtgtgtgtttctgtgctctctacacactgttcccaagggttgcaagggttcctgcgtcatggggcccacattattgtgtgcggaccttctaacacctgggctttagaggcaaagggaagctggagactgattctagggcaagttgctggtgatttgcaattctggaagtagacagtgaaaatgtagctgtggtcctgcctagttctggaacctagagagttaacaggcagctcttccggtccccgcccccccccccccagcctgtagcttcttgttgccttggaaatggtagccccgcccctgatgcagcacctgcccccccattggctgcagtggtgactgtggggctgaagggggagcccaggcctgggcagccattctggagctagagccggaacttggcatgcccccactttcattctcctctaaccccttggcccctctaaattccctggcagcagagcttcagcttgcctcctcgagctgccacccctccatactcctggcaggctgagcttcatccgcattctcctcccctcctcctcttcctctccccacccttacttgggagtcccctgaacctccactgctcacccccccactctctgcccactcccccactcccctgcattcctttcttttcctcccaaccccccttcccttctgaggccctgccactgcagtgcacgtggaccggccccttcttccccctccccccatctgccccttccctgaatttcctgtccccaggcttcttcccctgccactcctcacaggtcctttctaagacttcccccctccagaccagggagggggtcatgggaggcagccctggccctccagatggacaggggttccaggatgggggagctggtggaagatgtgcccagctgaggggaggggaaagcctgcctcaggtcaatgacttttaacccactctcccccccagctagccccttcctgggggggtgggcaccaaggacctagcttgtgtggatctttagtgtccttttaccactgaggttttactgaccccctcagccatgcccttctgctgactgccagtcccagtcatgggcctaaggcctcccaccccatccccttcggggggctccggctcgggttctttaccccctccttcccgccgccagcctctcagccgacgctgctcttcctgctgctttccggggggtaggtgaggctggagctgaggggtagagggaggtgggcgaatgggttggggtcagtggtggtcacctgggctgacagcgacccctgccaacctcccttctggctctttgcccccctccagaataccacttgggtcgctcgaggaggaagagcgtcccaggggggaagcagtacagcatggaggccgcccccgctgcgcccttccggccctcggtgagtgaaggcgcttgccagatgtggcccagctgcgccccctcccctccagccccagctggagcccagcgttctaagaaagggggctgcagggagagagagtgagagtgcgcgcacttgcctcttcccatctctttggtttccccctccttggctctgtccccctgcttttcagaccagccctcccaccttctccaggctggtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnatctccgtttcctcacctctagagactccccttctttccctcccactttcatccagggactctttaccagctgaggggggagtacgtagaactgacctttccccaacccacccctatccccatttcacccccaccccagcaaggcttcctgagccggaggttaaaaagctccatcaaacgcacgaagtcacaacccaaacttgaccggaccagcagctttcgccagatcctgcctcgcttccgaagtgctgaccatgacaggtacagggattagagccggggtggatgagttggatacagtacaggggctcttgggtgagactggagggcaggggcttgtccgggctcagagagcaaaggcctcagattggatgagggatgttttggggcaggagacagaatggagaagaggcagtagcaggagaggggcagggtgcagggagaggacaagcagagaggcaggatggggaatgaaggtgaggccaaggagggcctcttccagacaacagaaggatgggttccagcccaggattcagggagctctactggacagagaagtagtggagcccaggaggaacattgaagggatccagagaagggggcagtgggttgataggagagggagcactgtgagctagggagcagggtgtgagggaatggcagcaggttgaagtggggatgaggctggcaggtgctaatggaggagggaaggggaggctggcacaagtgtacaggttgatagaatggccaggggaagctctagggttaatcacagactagagaatgaggaagaagccctcagagaattcgggagggtactgtcagagagtactgtctccaaggcctaggccagcggtgcaggagatctgatattgcttctgttgtctgcttcttgggtcctctttgggtttctccctcacccagtcactccccagggagaaccctgtccttccttttcccccatgtctgcccgcccccaggattgggcaggtaggaaggttgggataggtgagtcacaccttcccctacccccctcccatgtcaccagagctggatttgagcctggtggggggggggggtgtggggtgaaggcatggtattcctggcccccggggccggggtggggggtggggggctgggggagcgtctcgctgacggcaaaggagcccaagatgacggggctgctataaatagcttcatggaggctcccacacccgagctccccctcccgctttcccactgctctccactcttcctcccctagccatctcccagccgctcactatcccatccctctgtattgtgtggcccatgtcctccgtccctcagccctctgtaccttctgctgtgggggggagggcagtttctgccccccccacccccgttcccatgcccatctttccacctgctcctcctcatcttctcccatcccgtctttctgcacgtggctttgcctccacctgctccctcctgccctacctcctcctcttccccaggccccatttcctagttcttccttctcacttctctgcccatagctttctcctatttcttgtaacttactttccctctttctgctgattttgctcaaccttgtcctcttcatgcattctttttggaatcactaaatgtttcttagatgctagctgtgtgccaggcccaaagagacatcttctttgtacttctggttcttgagttccactttttttcctttatattgagactctggtttcagctagaagtcctacctggaagtgtcccaggctcacctgttctttttttttttttttttgtctcatggatcattttggggttgagatatttccaggtgtccccagtaccccctcaggtgtgaattgggggtaggggtctcttaaagcatcctgacttctctcactttcctcctgtccttccttaaggataggccaatgttcttttcatctgtgtccccgtgggggaaggggattcacggggctctttccccaggtctccatcctagagctggcccctgagtgtgtaagaagagtgaggccctgaccctgtggcctgacccttccccgccagggcccggctgatgcagagcttcaaggagtcacactcgcatgagtccttgctgagccctagcagtgcggccgaggccttggagctcaacttggatgaagattccattatcaagccagtgcatagctctatcctgggccaggaattctgttttgaggtactgggtctagtgggctggggagggcaggagtgatggaggatgagggcacagagacctggagaaagtggcacaggtggggatgatgaggaaatagaaaacctctaggcctgggagagaggagggtaggccagggaggggaagacatggtgatggggggtgtctcaggtgcttaggagtcacctcccctccagagccccatctcaacccccacctctctctaggtaacaacgtcttcaggaacaaaatgttttgcctgtcgttctgcggccgaaagggacaaatggatcgagaatctacagcgggcagtaaaacccaacaaggtatcgggagtaaaggagacaaagacagcatgggcaaggcaaaggtcaagccacaggggaagctgggggcctagggggcaaggtgagccaaagggaagggaggcctggggaggaggggacctggatgaccaggaggtgacccccacttttctgaactgcccacttcctttaccatttttttctgcctcatggtctgtttctctactgtagaagtcacagacctagagtgttgatctgtcttctatgtaggcagcggtgccccaccagcaccctgacagccggatgccgtgcccctgcttgccgcatctccatgagactcttcccgttgtcagttagccaagcttccagaccttaatttcctctccataaagctggtgggaatggggtgtatgtgggaattgggtttatgtgggaattagatgatctctaaagtccctctggctcagaaattctgagtctgcattcttcccaaggcttctatttcctaggagaaatgcttccggttccaccagctcttcttggatcccagggtacagtaagctcacagccctggtgacccttctctgggggatgccttgtttttcgttgtctataactagacccaagaggctggatgctgtttgacccatgcagagtcggaacacctgctctcttcactcagcagcatcctgagcttcaccaggaccttgtggtccactgtatgccccaagcccttgcacacgaactctgcatatagcctcacccatcctgtatttttacaactcgcttttttgtttttgcaatcaatctctggttgtctttggggaggaccccccaattctgctctttaaattccaccttattacctttggtttattcttctagcttttgaaatttttcccagtgccgattctattgtctgatgtatgagctaccatctatattagttttctagggctgctgtaacaaattactataaacaagatcacttacaatgaaagaattttattcttccaagatttagaagaccaaaagtcccaaatcaatgtgttggcagaaccttgctccctctgaagctctaggaagaatccttccctgcctcttttttgggggttttttgggtcatttttttcttccttgcctcttgatagctccttgacttatagctgcatgggtccaatttctgcctctgtgtgtgtccggtgtctaaatctccctctgcatatagatatgaggcattggatttagggcccactctaatccagaatgaacacattttaacatgagtagatcagcaaggacccttttgtcagtgaaggtcacattcataggttccgagtggacatgaattttggagaagggtacactattctacgcggtacacatcttctcagccttatgattgctgtcttagaggctctgtctcgttttccaactgtctctcctcttctggtgtctctgtctcctctcccttcccctttacctgccattcccaccccaccaccccaggacaacagccgccgggtggacaacgtgttgaagctgtggatcatagaggctcgggagctgccccccaagaagcggtactactgcgagctctgcctggatgacatgctgtatgcacgcaccacctccaagccccgctcagcctcaggggacaccgtcttctggggcgagcacttcgagtttaacaacctgccggctgtccgtgccctgcggctacatctgtaccgtgactcagataaaaagcgcaagaaggacaaggcgggctatgttggcctggtgactgtgcccgtggccactctagctgggcgccacttcacagagcagtggtaccccgtcaccctaccgacaggcagcgggggctctgggggtatggggggctcaggagggggtgggggctcgggaagcggctcagggggcaagggcaaaggaggctgcccagctgtgcggctgaaagcgcgttaccagacgatgagtatcctgcccatggagctgtataaggagtttgcagagtatgtcaccaaccattatcggatgctatgcgcagtcctggagcccgccctgaatgtcaagggcaaggaggaggttgccagtgcactggttcatattcttcagagtacgggcaaggccaaggtgagtgctgtgcccttaggaataggtggcctgggagtgggcacttgcttggggcaggggatggatagtagggatagggcacttctgtcttcagaatgagcttaggttatacagaggctgatccttggatttttccgggcctcaggacttcctttcagacatggccatgtctgaggtggaccggttcatggaacgggagcacctcatattccgcgagaacacactcgccactaaagccatagaagagtacatgagactgattggtcagaaatacctcaaggatgccattggtatggcccactctcaggtcttcttcccaaacctaccagatgcacatcccaaccctaaacttggctactccagaccccaagtcacccttcctcagcttgatgcttctaagcctagagtccccggactccagcctccaaccttgggatcctgggattccccaacccaggcagcccccatccctgcccttgacaagtgtgaccaccctctgttgtgtcccccaccccaggggaattcatccgtgctctgtatgagtccgaggagaattgtgaggtggaccccatcaagtgcacagcgtccagcctggcagagcaccaggccaacctgcggatgtgctgtgagttggccctgtgcaaggtggtcaactctcactggtgagactgggaacgctgggtgggggctggggcccgggtcatgtgttcatctgttcattcatctgtccatccgcaaaaaggactgagtactggtcatgggcaaagcggtgtgctgggggctgtagagcagacagagaggaatgaggcctggccccttcccttagagggcctcgcccagaatggatagggtcagagtggatacacagaaagccacagaacactttagtgtgtgttaagcaccaagtgagggttcccccaggcaacataagatcagaggaggccaagctttgattgagataaacagggaaggcttcacggaggagatgttccccggggctgggctttgaagactgggtggggttctgataagtggatatggtggacaaagaagccattttaggagaaagctatgggatgggcatgtgtgtgaaggtaaggggcctgggagctttcggggggccagcagttagctcaggtttaatggagcatgtagctcataatggagagtgcaggagaagaggtccggacagggggttgaacttagaatctggaagttctcagctgccaggctaaggagatggagttcatcggtaggtcatggaatgccattagtggtgcttgtgccaagaagtatcatgattgagaagagtggtgtggagcgtggggcatgactggagtagagggagcaaagtccaggctatttggaggtaatggttgatggatgaggtgtggatcaggacggagacagggaagggagaaaggggcccactgtgaaggcctctctgaggaaaggatcagctggagctgtcaactgcctgggaagaagggagcttgtctgtggggagtcagggatgactcaagaggccaggaggctggtgtttgagacctgtggcctcattggcagaactggggaagtcaggaggaggagccagtgtgggggcgatggtgagctctgctttacactaccggagtcagagtttaaggtgtcagtgggacactcaagtggaacagggaggtgggggagtgagctctgagccactgcagggagtgggggtcacgcaggggcacctccatccccattgccctggaatccagaagagttggggggtccgagctccctgtacctcaagtgaccctccatctctctcccatctctgtctctccctggtgtctgtttttcttctcctcctctccttgtctctctcatacatcctccgtctctcccctgcatgtctctctcccctcaccttctctccccctccatttctctctccctgatctgtctgttccctctgccataggcctcttcttccagtagcctcccgtcttcctgctgcagaccccccctccctgtctctcccccactctgtttccacaccctcacctcctaccacccccctcagcatgttccctggaagctgagggtctctggggctcagtcctggtctctctctttctttctctctctctctgtctccccctcccttcccctcagcgtgttcccgagggagctgaaggaggtgtttgcatcttggcgactgcgctgcgcagagcggggccgggaggacatcgctgacaggctaatcagcgcctcgctcttcttgcgcttcctctgcccagccattatgtcgcccagtctctttgggcttatgcaggagtacccagatgagcagacctcacgaaccctaaccctcatcgccaaggtcatccaaaacctggccaacttttcaaagtgagggaagcctcaggtgggggtagggtggggatggaggtggcaggaagggtctcccaagtccccagagaccctgagacaggcgggtgtgaggcctgtgcgcgcgcgtgtgcgtaacacctctaccttctggatgccttggccaggtttacctcaaaagaggactttctgggcttcatgaatgagtttctggagctggagtggggttccatgcagcagttcctgtacgagatctccaacctagacacgctaactaacagcagtagctttgaaggttacatcgacttgggccgagagctctccacactccacgccctactctgggaggtgctgccccagctcagtaaggtcagcagatgcccccctgccccttccccagatgtctccagaggctcccatggcctgagagaccactccctgcacagtgctttctctcctccctgtccccaaaatgtgtctccactgctcccccagcttggacacccttcctccactccctctggcgctctcttcgagctgggcgctcagccctcaggtaacagcctcacccttccaggaagccctcctgaagctgggcccactgccccggctcctcaacgacatcagcacagctctgaggaaccccaacatccaaaggcagccaagtcgtcagagtgagcggcctcggccccagcctgtggtgctgcggggcccatcagcagagatgcagggctacatgatgcgggacctcaacaggtgagtacctggggctccccgcacctgtgccctaagggcctctacttttctcttccggatacgcttccctgggcccccgtgcatctctctagggcttgagaggaaggaaaaagaggcaggctctcagagaaaatggtaaggagacaggtagagtcagcggttagtctgagagcccattagggccagagagagcaagaatctcagagccccaggaagagtgcggaggctcctccggctccagcttgctatgagcctggggttcctctcagtccctctgcctctgtgcctgtcccagagctgaggttcagccagccacgtggggtcagccatgtggtaacaaaacgttgaactagttgtactagttggtaaataagcactggcccagccacccaccagaactgaacaggcctcaatccagcaattgagaagtagcatacacaccctagcaggacctcctaagccccaacatctgttccaatgcagtggcctcaactgctgcttgttctgctgaccgccccacttgttcctccagcctagtctccctccacaatgccatccccattccaccattcccacctctccttccatgcgtccacaccttccacccacctccttctctgtctgtgcttgcccctcttcccatctctctccagctccatcgaccttcagtccttcatggctcgaggcctcaacaggtgaggggctctcccctccccccggccccctctcctctcctgtctgctccccctccccctccagtggccttcactctcctctcctcttctcttccatgcaccctcatttcctccatacttgcccagacccacccctcatccctcttctcggtgcccacaccttccctcctcaaggctttgctcccttcccagaggggcctttccttcctccttcccacgtgtcacctcccgtgctcccttccagccttttttaaagctgctaccacagctttccacctttcctgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttgttccaggcccctcaatgacaccgcaggcgtgcgtggtgatggcccaccttcctcccatcaccaccatcaccatcatcaccaccaccgaggtggagagccccccggggacacctttgccccgttccatggctatagcaagagcgaggacctctcctcaggggtccccaagccccccgctgcttccatccttcacagccacagcaacagtgatgagtttggaccctctggcactgacttcacccgtcggcagctctcactccaggacaacctgcagcacatgctgtcccctccccagattaccattggtccccagaggcctgccccctcagggcccggaggtgggagcagcggtgggggcagtggtgggggtggcggaggccaaccgcctccattgcagaggggcaagtctcagcagttgacagtcagcgctgcccagaaaccccggccatccagtgggaatctgttgcagtcaccggagccaagttatggccctgcccgtccacggcaacaaagcctcagcaaagagggcagcattgggggcagcgggggcagcggtggcggagggggtggggggctcaagccctccatcaccaagcaggtacgtgagggtgggaagaaggacggatgggtgaggaacagggagggtggaaggaaatggctttgtggaagtgggggcagaatagagtctggcatctgaaatcatacttttctcacatcctctcattcattaaagaaattgtatacagagtccctgctaggtgccatgtcctgttctaggcactgtgggtttgacactgagtgccacacacaccctgccctcatgaagctcacctctccagaggggagacatgatatgtaattaaatagcattcacaaggagattgagactagagcaggggaatgagatgggaatggtcaccttctttagcagtgctctctcctaaatgcaccctaccttttcccacctttcctctctcttcacttccaccttgccccatcccagcattctcaggcaccatccacactgaaccccacaatgccagcctctgagcggacagtggcctgggtctctaacatgcctcacctgtcagctgacatcgagagtgcccacatcgagcgagaggagtacaagctcaaggagtactctaagtcgatggatgagagccggctggatagggtacgctgggcccctcatcttcccattacccacaggggcaacctctagatgcttctcagggaaggacccaggggtcaagtagttacagtggaaagaagagacaaagacctgatctcctttcttaagaagtgtccagtctattaggggacactgggtacacagtctgtcggaaagccaacttccaactttattttgtggcttatacacatcatagactgcggagaaacgttttatgttaaagcttatttccattttatttccatgttcttccccagggagaacagaagccccgattcctatgactactcaggaaagggacagctagctactctgccagcagtgtgagctgataaattgggtggggggccagagggctgcagttgtactacagaccatgtccagcttacccaggcattgttccaccagcacagatgatagagggttggtgttggaaagtggtatatgttggcccacgtgtggaaagaccagatcctcagctggtggtggcctagagcaaaagacagcaagagctcagggcacacacacatagctcagcagtgctccttggagaggctgttgctccaagggctctgaagaagagggtggctgtaggattaggttaacgtaaagactgtacgactccaactcggggaagcagagagaggtttcttgggagctgtggtttttgagcagaggaaaatgttgggactgtctagatggacttggtatagcaagtcccatgagagaattaagccctaatgcccaaggtagccacctttggtaataaatgacatctctcctttgcttccagagtggggttggttctgtatgtatcatctttggagaatgagaaaatactctcaagtcgttttttctgtactatgacttggatgagatatttttgttgaggaaggctctagaacagtaccatccagtagagttttctgcagtaatgagaaacgttctatgatctgcatcgtccgtatggcagtcaccagcctcatgtggttgatgcagctgaggaaggaaattttgttttatttacgttttaaatagccacacatggctagtgtctactgtattggatagcaccacagctctagactctagagccagtagggcagataaaatgactcctctgtgcccttcgagccccagaattccagaatcattatcaacagaggcagtcttagattctcagcctggagttgtttaaagcccagacctggaaccccacatagcctctccttatccagtgtcttttcttcctgggtctccccaccctccccatgtgctctggttggactgaggagtcaccttaagctttcatttctaggtaggatcactcaaggtgagtgggaggggagtctgtatatgtttgtgtgtgggtccttgtgtgtccagatttacatgtgcgggcaggtatatactgctcagggcatgggagcatatgatcttggtccattttaaaggagccttaggtagctccatagaagggtcttctcaaaagccaccatgtctggtataatcagcaggcagggaaaggactgcagaaggcacctgggttatctgtcccttaccatgcagtggctgcttggtaggcaagaatggagacggggtggtgggtcagggtgaggcgcccctcacagtgcggggtcgtttgcccggcgggcaggtgaaggagtatgaggaggagatccattcactgaaggagcgactacacatgtccaaccggaagctagaagagtatgagcggaggctgctgtcccaggaggagcagaccagcaaaatcttgatgcagtatcaggcccgactggagcagagcgaaaagaggctaaggcagcaacaggtggagaaggattcgcagatcaagagcatcattggcaggtgaggggcggcctggggaggggtcacaagggagagcctgaggctgaggagagccagcaagttccccctctagccttcagccccaaactcaggacaccatgaggaaagcccaccacctgctcccagagattgccactcactaccaatcaccaaatggggagaaacttctcgctcagggcataaatgaaccctgatctctctcccgatagagtaacttcttaaattcttggactccccactggttagtctcaatccagcctgtgatgttctccccaaatctaagcagagacctctagccagagtagcccctagccattcctatcctgggtagcccctccctccagccctgaaaagatgttctcttagaaactgaatgaccaaaaaaaaaaaaaaaagtaaaagaaaccgaatgacccttctgttagcatatgcacattttcaactgctctgccaaggcctggcttccaaagaaggtatctcagcaaggcggtcagcttatcctgagaagtggtgggactccaggctggactctaactagagccagtcccattttgatccactctgaatgtagtttggattaagattaattagaagaaaaaggcttgacttgaaacttactttgaaaccctgttgtaattgacatccttgatgggaaatcgttttgagaatcttcatcaaaggcacggaggtgctgggaatgatgattgtagagacccctcttggtcttggggtatcccaggggtggcactggtggtgtcctaggttcagtgagatggaatgggagatgtagaagtgaggccttcagccacagaggggctgtgggagggcactgtcctgaatgggagggtggagggccaagggggcatctgggtgatagaggtctttgaatcccagaaagctgtccttagcagggagatgtgagggtccctgaggggaaggttagtatagggagtctttgggtcataacaatagaaggattctgagggcagaggagaaggacgcctgaggcttttccagagagctgcaggggctcccccaggatcaggagttccactggcaggctccgagcccgtgcccgccactaaccccactgaagcccgtcccttcaggctgatgctggtggaggaggagctgcgccgggaccaccccgccatgcctgagccgctgcctgaacccaagaagaggctgctcgacgctcaggtggaaattacaatgtcatttatcttctccgtgtcccatccccatccatcccactgtcctttgtgcactcactgcaccagccacccagccccattgccatctgtctcccactgtcctccatttgtccactggctgctcctggcagcacccccagtgaccccatcttcatcccatcgtctatgcctttgtcactcctagcagtgttagccccacccctgtgcctttctactctgtctttcccactcctgtctgggtcttggagcatccagcagaacctcagtctctttgcccccagatcccacccagttcctggcacccctgccccatctgtgcctgttcctgttcacacagggaattcagcctcctctgagctcttcttgggctacaggggctagaggctgtagtttgctagaagagagcacagggcagtacgagttctagcttcccaggttctaaatggcccccatcacctcttgcctcctcaattttcctatctcctggatagctcccgaatagcttcctcctctgactcttcagctcttgaaagcccccccccacccccaccctgtaagcttgccttccctcagtatttaaccccagtgaaggcctctggtccttaaacctgtccagctctccagcgccctctgtcctcagccagcttttagaacttctatcctgcacccttgccccttgctctccccaattctactttcccacccatgctgctccttcctctgctctgaccgccaggcttccccaccactactgccaaggctcctgaccccatgaccccactctctccccctgcagctcctcatcaggtaattctcctggttcctttgaccacgggcggaggacacagggggaggtgactccggaccactgcaggttggtcatgaagcccactcccctctgactctctggagcctttccccaccccacccctcactgctgccctccacataccctaccctcctgacacctcctgcacagacccatctcccaaaccactgcccagagagagcacttcttgctgctccgggaactgttcagggacaccttgccaacaccaagcattttacctgggacacgcccagcacatccccacatctctctttgacaaaacccaccgcccagcctcctctcaatcctctgcctgtgcctctccagtgtatgtctgtcaccccccatttcaccagagcgtccttgggagtttgggacgttgggagtggggcttgttaaggggtggcagtgatgacgggttgggggaccctggctaaaggggctatgctgactgcagcaggtaagtgggagtttcctcttctttccctaatctcagttctccacccctcctcccactcctcacctgtttctctcttcctcctcccttatattggtgagatcgaaggcatctttagctcttattgggccccactgggtaggaactaggaatggggagctaactcaggaagactttgggggagggaggctggaaagaatgcttttcatgatggcaggacactaggcagggtgagtggaacaaggaacaaaaaaaggagcctcggcagatgtcaggacgcagaccagcccatgtggcgtgggagttggaagtggggtgagccgtcttcctagataagatcatgggctcagtagccatgtggattccgaggcagagatgccaggaacagcatgttaaataaactctgttcttctcagcggagctcactcctcctctcccgccacccagtggccttgcaggatgcagtcctacctacaaaccagtaaatgggaacctgtcagccactgacatcatttctgaggggctttctttctgtgggattgatctgcagtgggcagtggctcctcacactgtaattttaacactctgcctgcccagcctctttgtcaaagtagttcgtgatctgtaaacagatgctaaaaggcaccaggggacctcaccatttaaaggactcctgcagtgaattcttttgtaaaatgaataatggcaccctaatttatctacgttctaaatttgggtccatgggggagtagggggcatgcctatgttctgttgccagcagacaagcagagagaagggaatctgaggtttccttcccttgctgtcctgccatactcaggatcccctaccatacataatttcctctctcgctgacttgggagaagtgtgtgagatgctcagcaagctaagagggtggctttgcttaaggctggggtttcagtgacctgagaggtgggttctttgatttggaagggagagctgatctcgaggcctctacttagaatatttttgtatcctacagagatatggttacatgtaatgggcctaaatgccccatggcccgggaaataatctggacactttctaaatcacttttaagcactggtccctctgcaatgtaaccgttcgcttaaaagttaattttgtgcctgtatcttaaataaaaggcaagtgagtgaccagaagtgtcatacaggagtaccacagtgtggttcctctcccagcataggaacagaaaccagatgtgagggcaggaggcaggaggcaggagctggtccaggggtgggagtagggtctgctacccctctccctctaactgggatcccagggagagggattgaaaggaacatggaggtggaaaggaatgaagcagttttgcttcctggggacacagggatgggggcacgctgtgcctctgcagacactcctagtcatttctgcccagagagaggcagccctcccacattttttaccatcccccatcacttcctccaatcccttgccttcccccctcccccccaccaccccagtacagttaaacctctctaacttggactggtatattggagaagatgactgctctgaacaaatgacaaaactgaatggcagtgtctatttaatgaaatgtatgtcttcaaaatacatacagtaagtggggctcaatgaacaaggcttttccactcgaggtcctcagggagcatgcgttaatgaatagatagattcaaaagcctgttagctggtaccctcctacagacacgtttctactgttaatttgcttagcacaccctttcttcagagctaaaggaaaactcaagcccagtttttgttcagattatgaaaaaagtccaaatccgcaggggtttggattaatgaggttttgctgtactgcctccccttgttccctcaacacaaagttcctacctcggattgggggtgggctgggagggggttccatctaagaagaggagggaggctgggtaggggaagatccaaggggttaggttggggtgaggtaggaacttgtttcatttgaactggtttcctggtatgactccctgggttgaaggcctgttaggagtcgggggtgagattctcttctccctgatcccagaagatgtaacttcctctgcaggtgagaaacaaaataggaggatggggtgaggggttgtcctgggggcagggagggagacacggtttatggagtgggttggctactgggggggcacagctcggggagctggcacccaggctcccgcgaagcgtctcaataagtccgcgctctcctctttggtgtcttgcaggagaggcagcttccccccttgggtccaacaaacccgcgtgtgacgctggccccaccttggaacggcctggcccccccagcaccgccccccccaccccggctgcagatcactgagaacggcgagttccgaaacaccgcagaccactagcccacccagcatcacagacctcctcctccctcccatgcaccctgccctggaacagcacccaccaccaggactggatgttgcctatggacagtgggattgcctccctgaatgcctccttggggggcaccaatcccccacccccactgcaccatttccagcggggaagagtggggacccttagctgccccttttccttcctgttggagtgctgccccctgtgacccccagggacccttgccccaggacaccacctaccccacacagaccccttcagtccggggtgctatccccatcctctgcctcatcgttcccctgagcactgggggacagaccctcacccccaccctgggggtgtggcacctccaaactttcaacttcagggtgattttttagcagtaaccagagctgacaatctaattcccctccaccgccccattttggcctcccctgtcccccttgtaatggggaggggaccccgggtgagggggccctattaccccttgatttctcaggagcgtctgggggggctcagcacgcacaaactccttctcttcctactactcttaaatttactccctccccacccagaacccagatggggtggaggggccaccggggcagggagggggcggcaaggggggaatgggagttgtctccccttcctcccacacctgatctgctcttggctggtcccagagcggggtgagggggcttatgcccccccctcccccagtgtgttgggtggggtggaattgaggttagggtgaggggttagggtctaggagggtgtgtatgttagggaggacagactaggtgatctgccctacccggacacacacagccctccttgcccctcccctctctcttcttggtctctactcccagggggaggggggaacttactctaggaaaagccatgtctctctcccccagggtggggggacctgtgttggaggaggggtgttgggggcccccttccatgactctgtcccccccgggggaggtaggacagggctgggcttccctctcatcctcccccctccccaatctccctccacctccctccctcccgccagctccacaatttttcggtgtttctctgtacatagctctctggcgggataggggaggtaggatggatggggtttagggtgggtaggtcatgggaggggagaagcccctccttggcaccccctcttccctgactgctatcccctacccagccctgccccctcatcctttcttgcgtttggtattgagactctttccagacttcacccttctttcttttgtatgaacagttctccttcagacccatccccctacacacatacacccagccggggccaaatttatacttatataaaagttgtaaatatgtgaaattttatccctgtgccctttccctactttcccaaccccagaccctccccctggacctcctttcctcctctctttggctgttgtaattatctggggtttgtactgtacatatttgggggtgtgtgtgtgtgggctgggggcaacccctctgtatagagcttcctggccccctccctcccccaggcttccctccccctccaccaccctaaaggtaggaagatgctcttcctacttgttttattttgttttctcgttctccctccccaccttgtcccaccccactcccagccttctctgtcctccaccactatccctttttctccactcccagccccatttcctttttttctggagtgtgtggtgaaacagaaaaatcatgtttaataaacggagattgttcttttttcgctgtgctgactttcctaagctgggacattcagacgtatcaccctattcagtagggtgataggatctgctttttgagaggaagctggcagcctgggagaaaccatatccctgcatgatgccacagtctcctccagaatagcactctcccacccggccataagatgtattctgtttctgagcaggggttgtgacctggctaagcttacccaatccagctctcccctctccactgccccacttaaccctatgagtagagaggccagggagcaggaacactatctgacaaggaattccaagtatatatatctacacacactcacaactatatttagtaattacctagaaataaggttgatttaatggctggttaaaatgctcccgtacggaatggagcaaagaacttggtccctgaacaaatctgagttgcaatcccaggccggtcacttgccagcctccgtttcctccgaggaaactgagcagagcaacacctaccttgtagggctgggggagggtacaaggtgatgtggacgatgcctggcccacacaatagttcatctcgccttctcagcacttagaagggagcgggcgctacgtttaatcatccgcagggcttaagggccgccccctccttccaggctaccatctcccgaggcccagctcagattcctccgggcgtcagacacctcccgccggcaccgccttctcgcccgcgcagccaatcaacgcgaggctcgtagccctccgccctccgattggctggggctctggcaccgccccccgcacctggcgttggcgtccggcgcgaaggcggtggcttccggcccgggactgagcggtggctgcctgggcgccccggcccggtgccgccggtgtagccgcgggggcgtggcggcgggaagggcctcccggctggctggtgcggctccccgggagccggccctctgggcgccgtgagcaggagccgtccggggccggcgaggccaggccggggctggaaggatctcctcgtcttcctccgcaggccctggaagtgaaaccccggttggtcttttgttgtggtgttttagtttttcttttcttggtgggggagtgtgcgggcctgatctgcgggaaccaccactcactggaaagtttccactttgccgggttggggaggcgggtgttgttgcccttacccagagcttctgtgacccgcgtgcctttcctccgcagccttcgtcccgcgggggtgcgcccccagcccctcatctccagtgttccgccctctgggatttctctctctgaggaggccatatggatctctcgacgcctttgccccccgtaccctgctccccgacccgcaacccagccccacggacaatccagatcgagttcccacagcatagctcggtgctgctggaagccctgaaccgccacaggctagagggaaagttctgtgatgtgtccctgttggtgcagggccgggaacttagagctcacaaggcagtgttggctgctgcctctccctacttccacgacagacttctgctgggggatgcgccacgtctcactctacccagcgtcattgaagccgatgccttcgaggggctgctccagctcatttattcaggacgcctccgtctgcctctggatgctctgcctgcccacctccttgtggccagtggcctccagatgtggcaagtagtagatcagtgctcagagattcttagagaactagaaatctcaggtggaatttcaacctgtggggcgacgtcttaccacacttttctttcaaccacatcctctccaggaggctggtgcattcgctcttcctctttccaggccccagtgcagtcttcctccacctctagggagaactctgttttaggggaggggagtgaactgggagatgtgttacagattaaagttgaggaagaagaggaggaggaccaggggtcagcagccccttctcagacacctcagcctcagagggtatcaggagggtttccctgccctcatggatcccacccactgcctgtatccactacatattgtagggttccttgcgagagtgccccacttgagcctcctgcccttcatactgcaccaccccccaaagtcttctacattaagcaggaaccctctgagcctgaagaagagataccagggggtggaactcagtctggaggagcaaaggaggagaccaaagtgttttctggaggggacaccaaagggaatggagaactagggttcttgttacccttaggagcaggggcaacatatggaggaggaggaggtccatcctggaaaccagttgatcttcatgggaatgaaatcttgtcagggggtgggtggcctggagggggaggacaggctgtgcatgggcctgtgaagttaggaggtataccccctgaagatggaaaacgctttggttgcttgtgtggaaagcggtttgcagtgaagccaaagcgtgacaggcatatcatgctgaccttcagccttcggccctttagctgtggcatctgcaataagcgcttcaagctgaagcaccatctgacagagcatatgaagactcatgctggagccctgcatgcctgcccccattgtggccgtcggtttcgggtacatgcctgtttccttcgccatcgggacctatgcaaaggccaagggctgggccactgctcactggacttacaactgactgccaagggcatacacgaacttctaggataagagagccactgctgctgatggatactttttcatcaccaccatcacaccctgctcctggatcttgtaatcatgccaagaaaatagatatattccagacatctggttcttaagtgtggatgtcaacctggcagattctgggatctcagatttcttataaccaagttttttgctaaccaccccataggagggtggtttacagggcatatgtaaattgatcacttgccccataacagacctttcgtgcaggaaaccagatttcggattagaagtttggtgagagaaaagttagaacaaaagatgtaatgataaacatttcacttggtctccatgaggtgttgaaggagctggtctctattctagggatgtctgattctagggtccagtaattcagaaaccaattaaggtctatgctctcctctcccttgtcattgctgaaatgatttaggtagagttctttttatgtactttcttttgttcgatctttccagaagcctctcagatcataactcattctgcaccttcccaacacttcttttattaacattgtagttgagcactttaacaaattgagcgttccatgtgtcattagaactctctttttaatagaggatatcccctaaatagcctgtgcctcttgtttacctttgtccaccactgatcacccatatattgatcacggtgattagaatatgaccaaagaactcaggagatggccactgacctaaaatgctctcagggtagcaccactgtttttgaacaagtggctgttgtcagagactgagacagcacatacaggaaaggctgaagagtaactgcacagtaggaccataccccttatccatcccacttacacatgataggcccttgtttgagagagatagaagagtagatattggaatggggagactgtcacaggttacttaatttcttcaaataaactttgccctgaaatttaaactgacagtggattggattgagtaatttacgtgggagagacagcacgaaagcagagttgcaaagacttggatatgttacttatgcagcagggttatattgatgaggggaaaatgggatggtttcacactggtgcagagaacactgtcctggacttcagtgggccagattctaggccctgacttgccactgaatgatctcaggtaagttaccttatctttcagagtgtgaactgtttttgtttttgtttttgtttttgtggggtagtatgcatctcctaattggttctctgtcgtcttatttttaaagggattggttcatatgatctttacctataatcttccctgacttcatgtattacatataatgtttggtggttgtatggtttgttctacaaacatttagtgcaatgcagtatgctagacccttttactctgacctcaaaaagttcacagctactttcaaagctagacaaataataacactgtggtatgataagttcatattagtgggcagtacaggctaatgtaatggcataagtgaagtcaagagaaggtctcatacatcagcagaggtttcacaaagatctctttataccagagataataatatgggtggctgaacatgagtgaacttgaagttataactagggccaagattgatagctttccccaaagcattttccttaaaagttggtatgggacccagaacaggctgaaaaatgtgactttatggctgaggaggtgaattctagcttctgtaaagagccatgccatggtaccatcctcatggttaaggactgtgaacatattgggaagggagtcagggagagggctaccaaatgccacctacctgtcattcttttgacacattcagtaggtggctacagacatacctcagatattacaggttcagttccagaccactgcaacagagcaaaccaaatgcattttttaggttctcagtgcatataaaagttatgcttttacagtaacctagtaagtgtgcagtagtagtattatttctttaaagaaaataaagtatataccacaggcacttgggtggctgatgtggttaagcgtctgactcttgatctcagctcagatcttaatctcagagtatgaattaaagccctacattggcctccacatggcatgaagcctactttaaaaaaagaatgtgcataccttaaaaaatacttcgttgctaaaaatactaacaatcatctgagcttttaacaagtagtaatcacagaccacataactaatatattaataatgaaaaagtttgaagtattgcaagatttaccaaaatgtgacacagacacaaagcaagcaaatagtgttggaaaaatggtgccagtagacttgctgcaaacctttagtttgtaaaaataaaaacaaaaaacccctgcaatatctgcaaagtgcaataaagtggagcacaatgaaatggtgtgcctgtctatccattgagcaagatcctttggttgcaagcaagaaaagctggccttgaccttcccaaaacaggatctatggaagtatgtgaaatggctcctgaattggaaggaagggctgaaggaccagcctttggaaggataagcttgaggggtccagggagaaggattgctcctggggaatcttttcaggtcatgttttgggatgacagtcattcttatttcttttttattttttatttttttttcattcttatttcttttgttacttaagtcatttgagtggctcagtcagttgagtgtctgactcttggttttgactcaggtcatgacttcaggttcgtgagatcgagccccacatcaggctcagcacagagtctgcttggagttctcttcttctgcttcaggtctcgcctctggccagaggaccctgaatcatatgttccatccatcaaggcaacaaagtgggcatgtaatcctcaaggggaaattgaagtcctgggatagaagaggggaatggggaataatgctagccagccagcccacaggaacagaggtgcactccaatctccacatgttgcccatcttgggatccttaaagcctcagatatactcgccctctgaacttaaggcagaattgcttctttcctctccttagtctctgtaatactttttttattactgctgtaagtcaattaaaataccatgttagagttttgtttttgttttgaagttattaggaattatacagaaaacaaattccttaatgaaagatctggattgattgaaactgatttttaaagattttattatttgagacagagagatggagagtatagagggagagtgtaagggagaagcagattccctgtggagcagagaggctggtgccggcccaatcccaggaccctgagatcaggacctgagccgaaggcagatactcaaccaactgagcaacccatgtgccccgaaagatctggattttgaccagtgccctacttgagtcatggagtagccttcttcaggctcctctgcaaatgggccctgtggccaaaggccccagttcctgccacccaggatcgtgcacccaggcctgggaagggtcatgcggaggtttccaccagcccaggagctatcccctccagtggctcattcatggccacccatgactattataccacctgggttccacttccaggaatagcttctgcggaagtgcaaagtatctcggggaagccatctctcaccaccctggtctccccagaactgactgtgacctgagtcactggtgggcaaacttcttttttgggaagtctgttctctcagtcttgtttacagtactaagagttcccagaatgcttggaatctccccaggcctccagcagcacaatcacctgtgacttgactctggaagcagcctggtggctagccaggtaaagctagctggcaaaggcaacacaaggccccagtgtttgtatgtgtgtttttaagattttatttatttattcataagagacacagagagagaagggcagagacacaggcagagggagaagcaggctccccgcggggagcccatgtggactcaatcccaggaccccgggatcatgacctgagccaaaggcagacgctcaaccactgagccacccaggcgtccccaggccccagtcttgagtggtgttcaccagccacaaggtttcaagaggcactaggctcatcagagcctctcccctcccccatagactaggccaactgtagcaaacagaagcagttggattcttttataacagcaaaacaccaaaaaggaagttgagagaaccccactctttactatccaaatcacatgcaaaccttcctgacaccctgtaactatatgccttgcaccaaatggaaaataaactctaagcagccagttaaaaaaacaaacaaaaaaatttatatatatatatatataaattatagagtgtacctctctacctctgtcctctccttcttataatggaagaggtgtccctcctactgaccaaggctaatccccttcccaaaacccttgctcgtttaattaccccatctgttcatcattttcactctggagttcctcatttgtccttactcatgctcacaggtttgtaagaattaatacatgtaaaatgctgaggacagtaccttgccctcagtaaacttgataaatgttagctgttattatgagggagaccattagttccccactaatggggaacctttactgggatcagtgatctcagggaggggtcaaatatataaggggaaatattttcagctaagggggaaatgaggcatactcaatgtcattattacctttctcataaatactagagttcttcaggggtctttgcaccctcttctaactttatatattcctgggtgatttttatccactcttctgagttaaaccatttaaatactgatgacccttaattttatatctccatttttcccgacccccagattcacttagatttcctcctttccttccttcaacaatagggccagctggggcgcctgggtggttcagctggttcagcttctgactcttgatttcacctcaagtctccatctcagttgtgagttcaagcctactttaaacaaaacaaaacaaaacaaaaaaaaacccaatgaagcctgctgtgtacctggcactgatgagaagagcaggattatcacttgaagagacagatgtttaaaccaggtatgtctaaataaataaataaataaataaataaataaataaataaataaacaaaccaggtatgtctgtacttcatgggcctctcaagctcaatttgtctaaaatactgtatcccacctctagccagctgctctgttgtttcgaggtttagtaaaagttccactatccacccaaatgcccaagactaaaggctgggagtattcctgggcccctgtctcacatcccatactggccctatcaatgctatctcctaaatatttcaaattgatacgttctttcattcccaatactgctactgcaccctcctaactgtttttgtttttttttttgtcttgcttccctttgtgtctcattcccacacactatggccagagtgatctttctaaagcataaagtactgtttcactagctttccagcttaaacctttcatttgctccctcctgctctttgatgaagtccaaggatctgctcccaattgttgcactcttgccactcatgttttccttaggcctctgcttttttttttttctttttgctcctcatgcttatcactctgcctagaatagttacctaccctggaaataatctttagtgggctaattcttactctcttcagatatcaactgaagcatcacttcctttagaaatctgaccattaggccaaagtgggacctctgctgtgtactctaatagctcttattttgctgtcatagaattttcttggcatttcctttactcagtaagtatttgtcaactatccactgttatatgtgggtgctgttttaggcatggtggacagttcttaccctcataagattacattccagtgctgtaaggaaaataaatcaagtaataaggtggaggataacagaaaaggaaggcatgctgtacacattgatttagtatccaaaggagaagaaagacccagacttacaaagtgggacaggggagaaggttccaatacagtatgtagcaaatgcaaaggccaagaaagaaaatgaggcaggtgtgtgacaaaccaatggacttggagaggaatgagatgttgtcttagtctattggggatgctataacaacaccatagactaggtggcttataaacatttctcacagttctagaggctgggaagtccaagatcaagcaccaacagattgagcttcatgaggacttgcttccaggttcatagatgggtatcttcttaccatgttctcacatggcagacaaaggaatttccctgaggtctcttttataagggcactaatcccatttatgggactctaccttcatgacctaatcacctccccaaaggaggtgggagaatttgggggagaatactatcacagtggggggttatgatttcaacctatgaattttgggggaacacaaatgttctgtccgatgcagatgtgatagaagagataggctggggctgagttatatagagcctttcagatcatgttaaggcatttgggtttcatctgaaatgcaatgggaaggcaataaagagcttaaagtagagaggaatgatcttttaacattttaaagagattcctctagctacagagggaatattggatcatttggaggcaagagtggaaacagagacaaatcagactatttcagtagtacagacaagaggtggataaaagcagcagatatggagagaagtaaacggattaaagctattataattggaggtagggctaacacaggacgttctaacagattaatatagagattgtgggaaaataaaaatcaaggaagaccaccagaattttggcttgagtaattgaattagaggccatttactgagtggaagacagaagtagaagaacctgggagggatcaagggttttatctgaatggctagaagcagctggctgtacttgtccagtgctcttctacaccaggggttggcaaacttatgctataaaggatcaaatagtaattaggctttgcatgccaaaaagtaaaatcaaggatataacataagtacataaaaattaaagaaaacatttccacaatttattaatgacagaactcaaagtataatgattgagtacaattttttggtaatagaggtttgctgcttaattgaggtacaaagttagtattccctgtcatcaaaatcaattgcaaatgttcatttgttagtgtcgatctgtaatgagattttacatatttcgtctttgaatatgtctttcacacagatagtactgccaaatgctgatattaatccaatagtgtgtaattttaattgagcatattcatcacctgagagacatttatagaattcttttatattctttccttgatatttgccttttaccatgttattacattgtggattaatcacatcaaaatgaaggaggaaactcctcaactgcacaattaagtgaaatatagaaattttctttccacttgcattgagatttgaaaaacactgctggaactttagttcaagctcagaaaatatatatgcttcaaatccatgagggaatggggatcttgcttttttttttttgatcttgctttttgttttaacttttgatagcacaggaagtgtatacagccccttgacattacctgagattcattacctgatgactttgctgcagtatatgtttcctatattatcactgctttgccttgtaattttagattaaattcagtaggaagtattaccatgtttgcatcaagtatccactgatgggtgaatggataaacaaaatgtgatatttacatacaatggaatgttattcagccttaaaaagttaggagatcttgtgcatccctgggtggctcagtggtttagcacctgccttccgcccagggcttgatcctggggtcccaggattgagtaccgcattgggcttcctgcatggagcctgcttctccctctgcctgtgtctctccctctctctctctctgtgtctctcataaataaatgaataaaatcttaaaaaaaaaaaaaaaaaaagttaggagatcctgactcatactacaacacgggggaattttttttttttaagattttatttacttcatgagagaccgagagagaaagagagagagagagagagaggcagagacacaggcaaagggagagtaggctccattcagggagcctgatgtgggactcaatcctgggaccccaggatcacaccctgagctgaaggcaggtgctaaaccagtgagccacccaggtatccccaatacgagtgaattttaaagacattatgttaagtaaaataagaaaccagaaaagaaaaaatactatttgatttcatttaaatgagggattaggaacagccaagttcatagagacaagaagtagagcggtggtggctaggtaagggctgatgagaggagggaatggagagttactgtttcatgggcgctgagtttcagtttagaaagatgataaaggttctgcagatggatgatggttgtaaagtttctcctgccgacggtggtaagaaaagaggctacaaggcaagtggatctgagagatgaactttattgcaagcaccctcgggcgaggttccacgactcacggaggagaagagaaagagagagagagtgtgagtcgtggaagtcgcgctgggagggagttggcagggtccttttatcgggttgaggcaggccataggcttgtgtccgtattaggtaaggtagagaggtcatggggtgggagaagcccgtgatggacagttcccaactgggaagttcctgggtggaaaacttcagtttcctggtggtgacctggaggccgcagtgaaagtggcgggaaagtcgccatcttggagagggttggccggatgatccgccatcttggagccccggtccccccgctccccccccgcgcccatcaagatacactgcgtagcggtgtaaacgtacttattgttcctgaactgtatacttgaaaatggtttaagtggtaagcttcatgttacatatattttatcacaataagacaacaatatcaacaacaaataaccgaaccatgaatgaactaacggacataggcattgggcattagtggtgcaaacaaaaaagaaacaaaaaagactatatgtgcttcttatggaaaagaccatgaccacctatgaattagtctggcccaaaatattgaacttgaatgtgatcaagcctcaaaatataactaccaattcacagaaaatgcaggggacagggaaacatgtcaaaccacaccacagcgaggtaatcagcaaaacagactgcaagaaattctaaggaacaaacactccattttcttcaccaaaaaatttcaaagggacaaagggaaaggagggaaatctgtagtttcaaagattttcttttttagagtttattattacttttttttagtaatctctgcacccaacatggggcttgaactcatgaccccaagatcaagagttgcacacctccaactgagccagccaggaactccctaaaagattttaaaagacatattaactggggcacgtaggtggctcagttggttaagcagccaactcttgattttggctcagattatgatgtctcaggtcataagactgagactcacatctcctccatgcatagcagagagtctgcttaatattctctctttccctctcccactgccatccccatgctcattctctccctctctctctctctcaaataataaacaaataaataataaaagacataatagccagccagagtgttcagaccttatttggatcatagtttatttaaaagattaaaaaaaaaagcgagagagacaattctggcccttatgagataactggggactcaactaagtgactggacacttgctaatattaggagttactgttaaagtttttagttgtggggcatctgggtgactcagtaggttaagcattcactctcagctcaggtcatgatcccagggtcctgagatggagccctgcatggggctccctgctcagtggagagcctgcttctccttttctcccttgctggtgctgtctctcactacctctctctctctcaaataaataaataaataaataaataaataaataaataaataaaatcttaaaaacaagattttagttgtgataagggtattgtggtaaagaaggattcttgtctttggatggtatttgttatttatgggtaaataaatttattcatagttatggattgaataaaaatatcaaatatggggatccctgggtggctcagtggtttagcgcctgccttcggcccagggcgtggtcctggagtcccgggatctagtcccgcatcaggctccctgcgtggagcctgcttctctctgcctgtgtctctgcttctctctctctgtcataaatgaataaaaatctttaaaaaatatatcaaatatacacatacataagtactagataattgtataaattaaactataatttgtgtatttatagtcaatttttttagggcagcccgggtggctcagcggtttagcgcctgccttccgcccagggtgtgatcctggagacccgggaacgagtcccaattgagctccctgcatggagcctgcttctccctctgcctgtgtctctgcctctctctctgtgtctcatgaataaataaataaaaattttaaaataaataaataaatttaaaaaaaataaagatttttaaagaataaaatggaaaacaaaagaaacaaacaaaaaaacaaaaagtatggtttctttaagcatgtattttgcttttccagtaaaagtttattttaggataactgaatagttctagttaataaagagaattttcacagaatgctagttaaacaatgtaaaagaaataaaagaattagaaaaacataatttcatgaactccaacagaactgactcaggcaaggattatcgattggtgttaaaaccaatagatggggatccctgggtggcgcagcggtttggcgcctgcctttggcccagggcgcgatcctggagacctggggtcgagtcccacgtcgggctcccggtgcatggagcctgcttctccctcggcctgtgtctctgcctctctctctctctctctctatcataaataaataaaaattaaaaaaaaaaaaccaatagatgattggtaattgtaaacatgcatgcagagtcaaagtaataccatgtggattactttctagtctcaaaagggaaagcattaactgtaaatcgagggatcattcaccactaatttaatctaggggttcaatctcagcatcactaatgattaatcataggtgtcttctaatgggatgcagcattaactatacaataatataactatatgactttattcttcctagtatattttatcctagttctggtatccctcagaagatctttaagaatccattcctaaaaatatgttggatagtgaatttttaggtagtgggagtctgtaactcattattctattttatttttgcatgtcattttattttcaaattttatttaaattcaactaattaacatgtagtgtattattagtgtcagaggtagcattcagcagtgattcatcagttgtgtataatacctagtgctcaggcagcccaagtgactcagctgtttagtgcctccttcagtccagggcgtgatcctggagacccgggattgagtcccacgtcggggtccctgcaaggagcctgcttctccctctgagtctctgcctctctctgtgtctctcatgagtaaataaataaaatcttaaaaaaaaaaaatccagtgctcattacatcccataccctccttaatgctcatctcccagttatgagatacttccactcccctcccctccagccaccctcagtttgtttcctatgcttaagagtctcttatggcttgtctccctctctgatttcatcttgtttttccctccccatatgtcattcttttaaatgaaaaaaataatactgtatttccagcaggtctaaaaaccccaaccaatttccctcagtgcttaaaacactcttaaaaatctatataacaatcaactaggtttctctgcctttaaaacaccagttacttaattaacacttaattaactcaatgagtttatttgtgcaataacataggatactgatgttttcctcttaaacaattgttactgtaatgtaagtgaacagtgaaatgatatgttcaaaggcaaataacactcagcagcagtgaaataaacaaggcaagtttttaaatgtggttactgaaattgcagtgtcccttaagtgaggttggagatgagaagggagatatggaagttgtagtcactgttgctgtttagtggggggatgaaggtgaacaagaatgagcttgagcaggagtgaaacagtaaatgtctgaggttcatccatgccggtggataattagcttacctgagactcagcaatgagtctcagaagtggatggtcatgaattgtcttctgaaagtattgacaaagcacgacaagaaactaaaaatggacaatattacattccgtttgcttgtgttatgcagcttttgataaccatagactgtgctggaaattgcatttttaaaaaagatttatttatttactttagggggaggggagaggggaggggcaaagggagagagagagaatcccaagcagactcaccccctgagagtggagcccaatgtggagctccatctcacaaccctgaaatcatgacctgagtggaaaccaagagttagctgcttaactgactgagtcacccacatgccccggaaattgcatttttggatgtgatttttctgctcttgtcatgatcatgatctcttataagcaacagtgatgattctgtctctataatctagaatttctcttagtggagcctacctggttcagttggaagagactcttgatctcgtggttgtgagttccagccacatgttggatgtagggattatttaaataaataaaaacttttaaaaataaataaaatttcctttaaatatttgtcagggatgcgtgggtggctcagcggttgagcatctgccttaagctcagggcataatcctgaggtcccaggatcgagtcccacatcgggctccccacggggagtctgcttccccctctgcctgagtctctgcctctctctctgtccctcatgaataaataaatacaatctttaaaaaacaacaaaaaaagatttgttgtcaaatattagtcttctagggctgccattacaaaataccacagactgtgtgggttaaatgacagatatttctttccttttttttttttttttttttaagattttatttatttatttgagagagggagcaggagtaggggggaggggcagagactcaccactgagtagagagcccaacaaggggctcaatcccaggaccctgagatcaggacctgagctgaaggcagatgcttaaccaactgagccacccaggcgacccatgacaaatatttctcttctcacagttctggagactagaaattcaagatcaagatgccagcaggtttggtttttcctgaggcctttctcctcagcttgcagtctgccaccattcttactggtcacatggtctttcttagtgcacgggcactcctggtgtctctattctgataccagtcatattgggttaggctttcactcttatgaccttatttacctttaattacctctttagggacggttgggtggctcagcggttgagcatctgtctggctcagggcgtgatcctggagtcctcgatagagtcccacaccgggctccctgcatggaacctgcttctccctccgcctatgtctctgcctctctctctctctcttctccctctgcctgtgtctctgcctctctctctctctctctttctgtatctctcatgaatgaataaataaaatcttttaaaaaaattacctctttaaaagccttatctccaaatacagtgacattgagcatcagggcgtcaaatacaaaattgcgggggaggggggacacaattcggttggtaatactgctcttcctccaacttagctcctcccagattattacctccagtggaatgtgtttcttggaaggagcatggtaactctccggaatgaacaaaactttaatcatttgtgtttgttttctctcatacaggaaataaggtattccctggaaacacgtgcacggccatgcatatatatatttttttatgccttcacctcttagtacactttatcacttccaatatacatgtctctctagtctttttttttttttaagattttatttttaagtaatctctacacccaatgtagggctcaaactcacaaccccaagatcaagagtcccacgttcccctgacccaggcaggcgcccctctctagtctcttaagtcacctgctttcttcacagtttttccgtttactgtgaaaaatattactaggaacactggtgaacgaagatctgtttgagtccttattttcagttctttggactatatacccagaagtgggtataccgtcaaaagtatacataattttttgttgaaaggtggacatcttgaatattatgaaaaaaaaagaaaaggtaaggaaaattactctctagatctttccagattggctctggattgcagtaactccttcagtgcttaactaggccatttacaactctttcttagccttcacttcctgcttgcattgagcctacagatcagccagagatgaatgcctatgctcttctcaggtcttttctgagcatacattcttccctggacatatgtatggattttgagttcccacggtatacatgagagcttttcaagatccctgttcctccccaaatctctctggcttttcctcccaggtttttattgtgtctgttgtttgctccaacagctttatttgccccagaaggcagcagcttcttcatttgtctttcaatattctcaaagaatatcctcagcatagggaactctgcccgggtagagttctgacatagggaaatgaaggtaaggtccttatgttaatccttcaggaaaactccagtcaggtcaaaacagacaaacataattccttgggaacaaggtccattcttttccttctgaacagattgtacacacactgggaatacaatctgccatctttgagactgccaccaagccagggagagagtggacaagactaagttaaaacacttcaaagaaaacaacaacaacaacaacaacaacaacaacaaaacacttcgaagctctcttgccttgttacagtggcctttctcctggttaagcatttacttggttgctgtaagcccttcactaccttcctgaatacagggaggattgagctgagaaccaggcacaggacttgatttcaacagtagcagaattatagagaaggcttaaaagctgttaagactcctacatctgggtcgctggttggctcagtcagttgagagtctcttaatttcagctcaggtcatgatctcagggtcatgagatttagccctgcatcaggctctgcactaggtgtggagtctgcataagattctccccctctctctgcccctcctttccctgttttttctctcaaaaaacaaaacaacaacaacaacaaaaaagactcttacatcaaaatcagtgccctgataagaagagaatgacaacactctggtacttgaaatggggatattgtgtggacatgcttgagctccagattcccctgaacttgctggacctaaagaaatgtctcatttcccctttgttggatgataacagcttccacttattcagaaacatgtggaggcaaatgccttgtaagatgatacctgaagatttgcctccaacctcccatggtttctaggtcaataatttggatcattcactcaggggatcattcactcccctgaagatttgcccccaacctcccatggtttctaggtcaataatttggatcatttttttgtcacagcccacctggggaaatattgactccattttgggaagaaaaaaaatatatatattaaaaaatatattcatggatctttctaatatataccagtagcaactgggaaaatatgccagttttgagggtgttggaccaaggggattggaacataagattggataaagaagaatatataaggacactctttgtgacttgggatttaatgttctggaaaagacatctagaattgatcctagtacatcactgaggaagctccttgatgcttggaaaaacagtaccccataataaaagtaaatggagacgctggaactgccttgggaaatttagtatagatatgctagaatggatttatcttaagatcaaaaatcctatcagttgactgtgttccctgaaaggctcagaggatactctcctcaataaagcagtaaaaaatatgctagataagagcactgacattgttgagaatatcagtagtagctgttctttgaaaactaagtttcataataaaggaggttgatagggaaccagagtccctggggtcaatgagggtgataggattttgaaagagcagaggccctgatttaattagaggcaaggtggatataattaccataataagcagcaaagccagaatggcatccagaggggagaaaaccatggagatttgtgtcaatggctaataggccatggaatccccagcacaagatagatagaaagccagttaatatattactcaatctatataaccaaaaaaagatcaagagtggttgaaccaaagtctgatatttgctactgaaaaaaatcacaatcccccactcagttgctaggcttgagccaattctcagacccagaaaagactgaattatcttaaggaaggactgtgacaaagcagcagcaatttctcttatcctaaagggaactgatacaattaactaaggaaactgtacacaggaaaaaagagaaaacagcaagatcttttgagaggtgtgggtttcagagtctcaggtggcacttgtatcaggtacctaaagtgacagcatgtcccccctgttaagtagtgtatggagcctgggtgatagagtcctgacccaagtttttctcatagtggatctgtggacacatcccctggtaatatctctaattcctaagagcatggtaaggatggatatatttagattttggtaggccctcgcagtaattcccaggccaatggagtaagatccataatggtgggaaaagacaagtaaaatcccctaaaactatctttcctcttcccaccaaaccaagataagttagaagtagttttgcattctacatggaagacatagattagtatcatcctcagatacttaaacaatacagttgttatatatatttccatttatttcagcactgtgatgcctgtgaaaactagattgatcatggtggatggtagcggactctgtggtagtccaacatagcctctggatcttgtatatggcttttgatttggtaattgtgttcttttctatatcaggaaggaagatcagaaacaattcacattcacatgcaatagattgcagtgtacggtcatggtcgttcccagagctactctcctgctctcttgttccattataggctaccacgaccttggtcatctggacattctctagaatattatactgatcaactatattaaaaacatcttggggaaaaaaaaaaccatcttgggccaggaaataggaagtagcaagtagcctggatacccctgtaagatgcaggtacgccagagggtagaagacaagccatacacagatttggggctcatattagtgaagaaaaaggtgtccagatacatctccaaggtagaggggaacttactgcaccttacgtcttctgctaccaaaaagatgcacagtgactgttggtctttttggattttgaatgcagcaacagctatttgctgtaattttttcccctctctctttggttttcagcagttttattatgatatgcataagtgtgtgtgtttcttgaatctgtagtttgatgtttattaattaattattgggaaaattttcagccatgattctaacaaatactgcttctgtcacattctcggtcttttcatcttctagaattccaaccacacatatgttacactttttaccctttcttacatgtatcttatgctctttttggtatttttaatctctttgtctctgtttcagtctgaatattttctactaactcatttttctggtcactaatctctcttcagctgtgtcaattttgtcaaatctattaagttatcatttcatttactgtatttttacattctaggatctccactttttaaaaaagattttatttatttattcatgagaaacacagagggacagaaacacaggcagagggagaagcaggcttcatgcaaggagcccgatgtgggactcaatcctggaaatccaggatcactccctgagctaaaggcagacgctcaatcactgagccacccagttgtccctagaatttccactttattgatttttatagattccagctctcctgaaaactctccattgtgtcatcttttttcttaaacatattaattaggtattttaaaatcttcatctgatacctcaatatctggatcacctgagtccattcctattgactttctttcttggtcccatttcttggtatgcctggtctttctttttttcttttttcttttttaagattttatttatttaaagagagagcatgagcaaggggagggacagaaggagaaggagagaaagactcccaagcagacagtaagcccagtgtggagcccataatggggttcagtcccacaaccccaagatcatgacttcaattgaaaccaagagctggatactcaaccaactgagccatccaggtgctccatgactggtacgtttttattcaatgctgaatattttatgtgaaaattgtaaaaaaaaaaaaattgtagagactctagatgaagttaccttttttcagagaagacttattttagcttctctaggcaggaagttagagatacgacagatacattgatcaggaattgaactaatctgtggctgttgtgctctgtaaggctttctctatttctgatttctggttttcctttatttttttttttaagatttatttatttatttattcatgagaggcacaaagaggcagagacacaggcagagggagaagcaggctcctcacaggaagccggactcaggactcgattccagaaccccaggatcaccaccaccctgggccaaaggcagatgcccggccactaagccacccaggtgtcctagatttctggttttccattaactccaaggatttagatcttatttaactgacagcctggggtttatagggaactctcctccttaactggcctgaactccatgttttacgtccctaacaccatgagatagccaagaactccgtttagattctcatccccttggtatatgttttcctttcagctcctcagcctcccactgtgccccttgcaaagaggcaaatgcttcacaaagaaagtcatttggggggactctcctccccaggatctgggcccctcaggtcctgattgtctcaagagcccccctcatccctgtgaggtcattgaggaacctgctgagcttcttggcctcttagtggccactttctgaccagcttcttagtgtctcaccctgtgccacttataaactagcaaagacttattctttatgaagaattgagtagaatttggacgcacctcaatgatttttcattctttttggaaacttggcccctcaaattctggctgtcttggtagctgtctgatgccttcaaataaaatttgttttgttttgtttttagctttattcagcctagcttgttcttggtgacaagaacaagctaccccatcatagctgaaaggggggggggtctcttcttcacttggcagccctttcttgctttatttgcacatcatttatagccagttgatatctttttatgtttgtttatttattgtctgtcttcactcattacaatgtgagttttatgagagcaggcaattgatctcttttgttcattactgtaatgctaggacctacaacgacctagtacatagtaggagatgaataaatagttttaaataaataaatgttgcaatagcctgacaaatgagttgtaagcacattccttctcttcttctccccccctcctcccccgccggaactgtttgtatataagcactatagcaaagtaattgagagtattatgccagctatcaatttattaacactcagctccaaattcacccttcagaacttgctctgcagtaatggactggactatttaagcacttcttctgtagagtgagtataatgtagagggcacaggaggacaaaaggaagaacggaatttttcttcctggttccaatatgcagcattttgcttttattccccctgatacatggtcgatcagcaatgtgtgtatgtgtgtgtttgtgttggcctagacaggaaccatccaggagtgctctgctccagccacgtacccagagaatgcagccctgcagccaccatgaagccccagaggccccagtgcagacccagtacactccaggcctcatggctgtgcagtgccacgactccctctgcctgcccacccaccagcctcagcttgcttcaacccagttatttcccacttgaggtgaacaccacatattctacatgcctcagctgtctctgcatgtctgcccaccagcctcagttcacccacgctctggaggattgtgtcctgcttgcctgcttgctgactagctctggcctgggaaacccagcaaacttctctgccatccagtaggttgcggccataccttctccagtaagttctgagccataggcttgggcattcccctcagctttaggatacttcttaacttctttgtagttactgacctatcattgtttaacaattctttacattaagctacattgtttaaattactatgtggtttctgtctctcaattagacacaaagtaataaagaattggtaccaggaatggtcctaggaagtagacccatggaggtggcatttgggcattggtttggtaacacctttcggcttgagcatggcactgatctctttgtcaatgagaaatgggctgctagtaatccatagcatgcagtggcatcacaattacttggattatctatcatatgtagttgattgtgatgaagtgccaaatgaagcacatgccttgggagtctatgtggttgtggcctttcactgttatgacactaacgatgaccaggaaaagtgccaatggcctggcactcagtggagtgtgcaactattcatcttggtgttgtgagttcgagccccgtgttgagtgtagagattacttttaaaaaaatcttaaagattttgactataaagattgtggtgtgggacaggtttttttgtttttgttttttgtttttgtttttttttttagtatacttgagcacttataaaaggaaaataatagctcagtctattaagtctcagctcaagtatggaagcttccatgataaccctaaaggaatttcttttttttttttcccttttaaatttatttatttatttatttatttatttatttatttatttatgatagtcacacacagagagagagagagaggcagagacacaggcagagggagaagcaggctccatgcaccaggagcccgacgtgggattcgatcccggatcctcaggatcgcgccctgggccaaaggcaggcgccaaaccattgtgccacccagggatcccaccctaaaggaatttcttatttcttatagttccagggctgatattactaaaaatcaaaaccaaaatttaattgtgtaggttgctgaattataatggctattgaattaacagtcttgccaagtttgtcgtgtgaaagttaggcactgatctggaaagaatgggattctgaaccttgaaattgagacatcccaaatgaattgagacatccaaataaaactgataatcttgaacccccaggtcatactgagcccccagagtttgccctctcatgtctgaaagtgatggtttttctctacttaaaaaacttgtgacaatctgacctgaagcagatgccttgaaagaggatgataattcttctcctcaggatccaccacagccacccccttttgccactaggcccataaatagtgtaagccttagcatgctccagaggtacaggaacacaatacaacccaggagaaagtaatttaggctaaaaagaattgcagaacttttctaacatgtgttggtagtaactgcagaatatgtgtgggaatgggttcttaggttggtaaatcaaggagggcaagatatataacactagatcagaaaaattaaaaaaaaaacactatatcaaaaattttaaacatttttaaatttatgtaagtaatctcttcacccattttggggcttgaactcacaaccctgagatcaaaaaacaaaaaaaacaaaacaaacaaaaaaaaaaaacctgcttttccaatggagccaaccagatgctcccactatatcaaattttttgtataaatatgcttactagaattccagatgtagtatgttagcttgtgtagctagaggtgactttaatttatttggttggttgactgaaacttgaactcaatattccagtttaatgaggtttaatttaatgcagtcaagatgccagagcttttctggtgtgaagtgaaggaggaaatccagatgtgcagggaggttgccatgttggattggatttatcatgtgtgacctatcccctaactatattctatgtgaagggggaaggcattgtgaaatatatttgtgagggaagcacctctatcctttaaaaggtctgtggtttctctcccttgtaggccagttatgactgtagggaatgccactttcttttttaagattttacttatttatttgagagagagagagagggagagaaagagagagagaaagagaacaagctaggaggaggggctgagggagagggagaagcagactccccgctgagcagggagcctgatgtggggcttgatcccaggatcctgggatcatgacctgagccgaaggcagatgcccaactgactgagccacccaggtgccccagggatgccacttttaaactgcacttctttttttttttttttgtatatttttaaattggagttcgatttgccgacatatagcataacacccagtgctcatcccgtccagtgcccccctcagtgcctgtcactcagtcaccccaaccccccgcccacctccccttccactaccccttgttcatttcccatagttaggagtctctcatgttctctcaccctcactgatatttcccactcattttctctcctttcccctttattccctttcactattttttatattccccaaatgaatgagaccatatgatgtttgtctttcgactgacttacttcactcagcataataccctccagttccatccacgtcgaagcaaatggtgggtatttgtcatttctaatggctgattaaactgcacttctgattttttttttaaagattttatttatttattcatgagagacacacacagagaaagaagcagagacacaggcagagggagaagcaggctccatggaggcagcctgacgtgggacttgatcctgggtctccaggatcacactccaggctgaaggctgcgctaaactgctaagcccccgggctgcccatgcacgtctgatttcaatgaggatgttggtactgttccattgtagcagaggccaaatagaagcacttaactgtcaaacacagggtgggcacctcaaccgtaaagggcattggggatggttcagtaatcagaatgccttggcctgtggagatctctagtggtaactaattgatcatggtgtctttaggatgaaatagataatcagcctactagaattgcttgatccatgtaacaggaaaaactctacatctggtagccaatcacctaacttgggtcaccatagtagagtatgatgccctctcactcagtgtccagacccaaacccagtcagtttgcagacccaaagcactttcaaaaagccaggttccctagagaaaggaccttgctccaccgccaaaaataaataccttaatcttccttcaagcattcccaaagaaacgcacaactatttactggagtgacagtgcactggggaaaaggaattacctgggcctttcgggggctactagacaatggctctgaactgatgctaattccttgggattcaaaatgccagcaaggctcacccctacccagagtaggggtatctgatggataggtgatagaatctcaactcccaagtgtgactctcaacaggcccatggcccatgaactcaccctggggctatttccctggttcctgagaatgtaattggaatagatgtttggccaatgtcagaatccccacattggctcttacctatgggatcattatggggtcgtgatggtcggcagggataagtggaagcctctggaacctccactccctgccaagatagtaaaccagaagcaacactgcatctctgagggaaatgaagacattgacactcccatcaaagacttgaaagaagcagagctagtgactcctaacccttcccatttaattcaccagtttggtctgtgcaagtcaagtgtaatcctagaaaaatgactgtgacttaatctggtgggattccagctgcaggtgctatttatattcaagatgtagtccctttactggacttctgactcatcttagaagttgcgtgtgtgggatcctgggtggctcagcagttgagcacctgccttttgctcagggcatgatcctggaatcctgggatcgagtcccacatcgggctccccccaggagcctgcttctccctctgcctgtgtctctcaagaataaataaaatattttttaaaaagtatcttcttaaaagattgattttaacttgattgcattgtagtctaagcatattgtcttctatgataatgacctttgcaatttgctaagacttactttttccccaatacacagtcaatttttgccatttttgtaagtgtcccacatggacttgacaggaacgtgaattctctaatatttgtatgcaagattgcttatctatggggtgctaatctacttctcactttgtctacctaatctagatagttctcagatacatgttaaatcacccattgccattgggaattataaatctctccttttggttctgttagtgtttgcttcttatatttataaagaatatggggcagccctggtggcgcagcggtttgtcgctgcctgcaacctaaggtgtgatcctggagaccctggatcgagtcccacgtcaggctctctgcatggagcctgcttctccctctgcctgtgtctctgcctctctctctttgtgtctctaagaataaataaataatcttttaaaaaaataaactatgttattttgtgcatacaattaagaattttaaactcttccttgtgcattatatcatctgtgattatatagagatcctcttcatttttttaaaaaaactcatcaggaaaaaataaaaaaataaaaatcatcaggcattttattttattttatttcatttttattgaagtatagttgacacacaatgttacattagtttcaggtgtatagtggtgatctggctaatttataggttatgccatgctcacttcaagtgtggtaacatttgacatctgtcatcatataacactgtgacaataccattgactatattccctatgctgtgcctttcattcctgtgacctattcattccataatgaaagcctatttctcccattcctcttcacccactttgcccagcaccctgccctgctcccctctggcaactgtcagtttgtcctctgtacttatgtgtctgtttcagctttttgtttgtttattcatctgttttattttttagattccacatatgagtgaatcatatattatttgtctttctctgacttatttcacttagtatactaccctctaggtccacccatgttgttgcaaatggcaagatgtcattctttttcatagctgagtaatattccactgtgcatatatactacttctttacccattcatctctcaatggacacttgggctccttccatatcttggctcttataaattaagctgcaataaacatggtggggggtctatatgtcttttcaatttagcattttcatattccttttttaaagatttctttatttatttgagagagagaaagtgcacaaggtggggaaggacagagggggagagagccttaaggagactccacactgagcatggagcccaattcggggctcagccccccgtcctgagatcatgacctaagctgaaaccaaaagtcagatgcttaactgactatgccacccaggagcccctagggttttcattttctttgagtaaatacacaatagtagaattactcggtcatatgatatttctattttttaattttttgaagaacttccatactcttatccacacacagcatctgcactaatttacattcctatcaacagttcaggaggattcctttttctccagatccttgccaacacttgtttttcgtctttttgattctagccacaccgacaggtgtgaagtaatatctcattttggtttggatctgcatttccctgatgatgagtgatgtggagcatcttttcatgtatctgttgggcagccatatgtattatttgtgggttttttggggttgagttttataagctctttttaaaaagattttatttatttgacagagagagatcgagagagcacaaacagggggagcaggctccctgctgagcagaagcctgatgtgggggcttgatcccagaagctgggatcttgacttgagctaaaagcaaactgactgagcgacccaggctcagttctttatgtattttggatattaaccccttactggatatatcatttgcaaaaatcttcccctattcagtaggttgatttttcattttgttgatggtgatcctcttcatttcttttttttttaagatttcatttatttattcatgagagacacacagagagaggcagagacataggcagaaagagaagcaggctcccttcagggagcccactgtgggactcgatctcaggacctcaggatcatgccctgagctgaagacagacgctcaaccactgagccattcaggtgtccccgatcctctctctatgttagttttttgtctgctatgtctttttaattttttttattttttgagagagagagagagagagcatgcagcagtggcaaaaggggcagaaggaaagggagagaatcttaagcagactccacactgagcccaatacaggacttgcttccaggaccctgagatcatgacctgagccaaaatcaatagatgcttaaccaactgagctacacaggcaccctgtctgatatgttttttttttgcatctatctattttaaacttttctgtacctctttgttttatatatgctctagtaaatagcatatggcttcatatttaaaattcttccaacccaacaatccttggaaagataggaagataatatctattctgattagtgatatatttggacctattactatcatcttgtgctttgtgactttcttatgatgcttcttccttctttcctgcttgcatttgggatgattgtgttttcttttttcctttatttcctttctagaggtttgaaagttatactcctgtttttattcttttggtaaatatctttaatattttggggcacctggctggttcagttggtagagcatgcaactcttgatcttggtgttgtaagctggagctccatgttgggggtagagattactttaaaaaaataaaataggggtgcctggatggctcagtcagttaggcatccagctcttgatttcggctcaggtcatgatctcagggtcatgagatcaagccctatgctggcctccgcacggagcatggagcttaagatgctgactctccctttccctctgcccctcctcacactcacactctctctaaaaaaataaataaaatctttagtattttaacatgcatacctgccagtttaaatttacttaacttctgtaccttctttcagaaaaataaagggcctctgagtgctactacactgaccatctcccttccatctgatgtgttactgtatctagtacacagttgtaacttattttatataccccatatttatgctattattattgctttatataatctaaacatgtttacatgtactcaagtctttatttgtaaatttttctcccttgcatctcaatgtcccgtttttccttcatcctgaaatacagcccttaggaatcttccactctgagtttttctttgaaggaagatgaccttatttcaccctcacttaaaaaaattaacttgggcagccccggtggtgcagcggtttagtgccgcctgcagcccagggcgtggtcctggagacctgggatcgagtcccatgtcaggctctttgcatggtgtctgcttctctctctgcctctctctctctctgtctctctctctgtctctattaataaataaataaagtctttaaaaaacatttaaaaaattaacttactttacatttttaacatccagaattttagatgtcttgatatttcagtcttaaatatttgtgcctacattttgaaaagaactcttactcacatagaccaaattaatacaaacacatctaacaacaggaacagtagtaattccttaatatcatcaaatgtccatttcatattcagatttccccaatggtgtcagattatcagattcagatttatcagataattcagattatccccatggtgtctgtttttccaaactagatccaatctagaacgacatcctgcatcagtttatttattgtgtcccttaagcctcttttaatttcaaactctttttttgtgacactgattcggtggaataggctggttgtcctatgaaatatcctcgcttctgggtctgattgtttccttatggtggtgtttagcctgttcctctttcctctatatttccttataactgtaatttagggtccaaaggcttgattagattgattgattgattgattgattgattgattcatgagagacacagagacataggctgagggagaagcaggctccactcagggagcccgatgtgggactcgatcccaggactccaggatcactccccgagccgaaggcagatgcccaaccgctgagccacccaggtgttccaggcttgattagatttaaagcaaacattcttggctacctcacatcacaggtgatgcagtattcacaatactatgttactgatccagctgttagataataaacattcttgcacaaagttctatgctaagattgtgccccttgctaattggggctttgggggctttttttagataggacttctggggacacctgtgtggctcagcagttgagtgcctgcctttggctcaggacattatcctagagtcccaggatcaagtcccacattgggctccctgcatggagcctgcttctcccttggcctatgtctatctctgtgtctctcatgaataaataaataaaatcttcagatagcacttctgtgtgatagattccagggaagttccgataaacaaaagactgggaagtgttggaaaatgcatgctgaagatggaaggacatatatatttaactgctaactagcacacagtatggtaggaccatctagcttatgcctctgaacatgtagactttcgctaggatataaagttaaaatgtcactgttggttcacagcattaggagtttcctggtataatctgaaactagtccccatctacagggggagggagagacagaataaagaggtggggcacctcagattggtaggtggcagttttaataagcaagggaaattacttatgggcttgtcttgggcagtgaatagatccccagcacccacccaccaaatcttataagtttatatagaggctttaacttgtttcagtcatgtatcccatctaggtggtctcaataacatatttctttctcaaggcttcgtatttgaaaaaggctcccaccatgagaatggaagggagaatgtacattccaaggagaggggagtgtgtgatgagccttgggttcagctcaagggtcaaatggccattacatcctcttgaccaacttctccatcagcagcatcaatgggcagaaggaaactgcatctttgactctaccacttgataccaaattactttccagttagccaatttatgcctccaccaatgccaatacttggtattttcagacttttcttttttacttttgacaatatgactagatgaaataatagctcattatgttttttaatagattttatttatttattcattagagagagagagagagagagagagagaggcagagacacaggcagagggagaagcaggttccatgcagggagcctgacgtgggactcaatcctgggtctccaggatcacgccctgggctgaaggcggcactaaaccgctgagccacccaggctgccctcattgtggtttttggaaagttattacatacatcaagagatttcacccctgaatacttgagtattcatcttttgaaaataaggacatttcctacttacccacaatatcattctaacaaaagaataattccccatacaatctaaatttgtctatattcatatttctccaattatctgaaaaatcagtaaggatttaggttcaaggttcaaggcacttttatcctcaaataatggattagctaggtgtgacggtccaaggtatcaggtatttcctctaagaactaggaagacaataatcctctgtcttggggtttctatagttgctgttgagaaatttattattggtcctggcatcactgtattatggaaaacatgttttctttctggtttcttttcaaaggtttccccatctttgagttcttcagtttctctctggtgtatctggatgaatatttagtagtgtatcttggaattaatttcctgagactgagaattcttgtccaaaatcagttctggaagatgatcaaccatgatctcatcacctcattattggtgaaagattatgcctggcacactttaggtgcttagttgttgaataaattggtaaataaatgagcattttctccattccctgtcattcttttgagtctctggtgctcagatttttttacagatatttgttcaaacatctcactctacccactataccttttcctctattatttttcttgctacattttatttttttaactcaccatttttatttatttatttatttatttatttatttatttatttatttaagctctacatccaacttgggacttgaactcatgaccccgagataaagagttgtaccctctacccactaaatcagcaggcatccctttttctgtgctacattttagataattttgtcagatctatcttctagtgctcaattctaagctcagctacttttttttctttaaagatttatttattccagagaaagaatgtgtgtgagaagggggaggggcaaagagagaggcagagagaatctcaagctgactccatgctgagcacagagcccaatactgggctcgatctcaccaccctgagatcatgacctgagacgaaaccaagagtcggatgcttaactgactgagccacccaggctcccttaacctcagctacttgtaatcatttgcttaattcatccattgagtttataataatcatttgtaatcattgataccggaccttttttttataacattctgttatttctcatgcttttgattctttgttttatgatgtcaataacttttaacatacttatagcttgaagcttatactaattccattgtctgaagtgatccagggtctaatcctgctctttgttaggtaggtaaattttcattcatggtggattatttccttgtgggttttccagttttggattgtgaactcatgttgatggccttcaggagtgaccttcataggctatagtgaagattaaatcattaaatcaatgaactcagatatgtctcaagttcaggtggaaattaaatcacatcgaaaagagtatacagaagggcaagaactgtccaccaggtcatgctatatataaaagcaatgcagggcagtccggtggctcagcagtttagtgctgccttcagcccaagttgtgatcttggagacctgggatcgggtcccatgtcgggctccctgcatggagcctgcttctccctctgtctatgtctctgcctctctctctctctgtgcctctcatgaataaacaaataaaatcttaaaaaaaaaaaaaaacaaggcaaaacccccacaagattgacatgcttaaaccatcaaactctggccagactcacactagggaatactacaaacactgtctctcatgtgacaggcactttattcatatctttaaccttcatatcaactgcaaggaaggtgaaattcccattcgacagaacagaaactgccaaagaatcattaatttatagctaattggtggactccaattaaaactcaggtcgaatgattgtaaagatcatgctttctcaaattgaccccattgttcctcagaactattactggagggtgaatgggtgacgggcactgaggtgagcactgggtgttattctgtaagttggcaaattgaacaccaataaaaaataaatttattaaaaaaagaactattactggaaaaaaacaccatcatttggactacatacatattttttctaagttccaattttaattgaggccagttaaccccatggatcataaaaacatgttgagtaagtagtgaaaaaggaaaacgaatgcattaaagctacaaaagagttgcattttaagtaaagaaactttcattcctcatttcctttcatttttccaatttgagattttgcttatgtacgaaaaaggcaattaacaagaagcttacttatgagaaacccccggagctcccagaagctaataaaaatgtatctgagcattctgagtacaacaaagcaagccagtgtaaatttgatctaataaggagtttgcaaatataccttcaacctaagcaattttacatcagtaaaccaggacaagttaaagccaattggtggcaatacttttcagctgtcaatcctttgtttccaggtccagagaggccactgcaatgtgcccgctccaaatgtaggttggagcacccccaccccccttgcctgtccagctcttccaagaatcatcatccagggatcactgaggtaatcgggaatcgccaactgtcttaaatattatcagcataaattgcacctagtatatggagttagagggtctgattttaatcaggttgattcaatttgtgacttacttaaaatgctggtctgggtttcttgatttaatcaactttcaacaaaagttagtgcttatcatttgatagaaattttatacatgatcttcacccctcagatctggctctaggttacattttactatggggactttaaaatgatattaataccattgaataattaactaattaaaattaatcattaactttgcaaatgtatccaaagaaatatagaaagacgattctgctaataaatttaggaaaaatagaggatgtaaataattgtggagtcactgggaggtaaactctgtccagttaattggtcagttttgtattttgaccatgagtttatttttgttagactctgtgaagagacgaccattactgacgttattaaagtattttattttcctaaaagagccacatcatataatctggattctttcttctatctgtttgactttaaccaaaccgattaagtgattttaatgctatgaagcaaaacaaataaaatattgttaaaatgtaaaatattgttaaaatttgtaatcatctcaacgtgaaaaatcaccttgccttcctatttagagccccttaaatataagctttcttcctctttcagtttccacaggctacagagtaaattatttcttttttttaaaaatttttatttatttatgatagtcacacagagagagagagagagagagagagagagagagataggcagagacacaggcagagggagaagcaggctccatgcaccgggagcctgacgtgggattcgatcccgggtctccaggatcgcgccctgggccaaaggcaggcgccaaaccactgcgccacccagggatccctagagtaaattatttccactgaaaatgttctatccacatctgctttaagaaagccactgctgaaaaaaaaaaaaaaaagaaagccactgctggggtgcctgggtggctcagttggttgagcgctggattcttggttttggctcaggtcgtgattgcaggctcatgggatcaagccccccacagtgggctctgcgctcagtgctgaggttgcttgagactctccctctgccccccctgccctgtgctctctaactaaaataaacaataaatcataaaaaagaaagcaagtcggccactgcaagctgcatgctggcgttcatcccagctgcttgcactcccgcacaggctgggatgaaggttcccaggcctgtctctgcacgggtctgggcagggcttctctgtgctctgaacccaggtgagagtcggcacatgtgccaatagcacaaagcaccacaggtgcctctccagagggcggtattctctatgtatccacaaaagttgcccaaggagcccagctccccagctcttggccagtgtttcatatttcccacgtttctaactttggtctctctgactggggtaaagaggttatctcattgccatgaatttttcatctcattttttttttttgacagatcctgccgcatgtttatttgtacaaatagcgcaggaggacaccagccccatgcagatagaagctcatgggtcacacccggccttctgtcctcacactggcagactggagcctctgcactggagcctttgtgcaaaggggcctgggcacctttgggagcctgagccgcagcaggagctgcagctggagtcacagctgtagtctgagtcttgtttaagccttggtcttggacttcggactccagagccctgagaccctgggcaatgcggcaacgagcagatttcccaagcttggggtgagcgatgcaggcaagttgagcttgcggctgccaccctttgggatcttgggcttgacctccttggggactcctggccttggtgttgttggcctgcgtcttcttcaaatctttcttgttgtgcttctgggaaaagtgcatgttccttaggaacataggatctgccctcttaagagaatcatatcttctttttttaaagattttagttattcagaaagacacacagagagaggcagagacataggcagagggagacgcaggctccatgcagggagcctgatgcgagactcaatcccaggtctccaggatcacgccccgggccgaaggcagaagctcaaccactgagccacccaggcatccctcatatctttttttttaaagatttatttctttattatttgagagagaaagagagagagaaggagcagtagagagagaatctcaagctgactccatactgagtgcagagccccacatggggcttgatatcacgactctgaaatcatgacctgagtgaaaaccaagagttggacacttaattgactgagccacccaggcaccccaagattcatgtctttgtgactaggtttctcgatgccatttctgtgccatctttgtgactggttatccacggtgttggttgcatttggccatgcctgaacccgagcccgaggctcccaacatgccttccatttcatttactgcatttattatttgtagaagtccagtttggttcttttaaagatgtacccgtgtcactttttctaccttcctattccctgtagatatattcaacctatttctttacaacaataaatttttttaaaaagattttatttatttattcatgaaagacacagagacagaggcagagacagaggcagagggagaagcaggctccacacagggagcccgatgtgggactcgatcccggaccccgggatcacaccctgagccaaaggcagacgctcaacctaaaactaatgttacactgtaggttaactaactagaatttaaataaaagaattgccatttgaaaattgaaaaattaaaaaaaggcagacactcaaccgctgagccactcaggcatccccaacaataaacttattttatcatgtgtatcatatagttccattatctaaagtctttacatggggctgcccctaggccttagggcatctttctacaaattagaaaaagtggcccttcttcaaccacatgtttttgaaaagttagaagattaccacgaaacctgaccagctccaccagggagaaaatttcaacttgggggtggcacacacatgcacacacagtgtcgtgcactcacacaatgcctggccactggggcacacggctcctgatgccacacactccctccgtgccaccccacccctaggtgtcagatgtggagtctagcagccgggcagatgtggaaccgggcttctagggcagcaggctggagcctgatttccgtgtttcccgagttatctttgactatatgttggttattatatttgaaaaattatttgtaggagtaatttgggatgaaggtaatttcctccacagagaatttgtgtttgctgcttccaaaagcctgagggcactgccagcgctgagatattcagagtcaaggccgcggataccctgggtaacccaggcaaatggaagcaggctgttcattctggccggttggtccacttctggtttacacttaacctggcttactgggggcaatggggtctcccattagacttttccccgcccccgcagggctgtggtggagacacattcatctcaagaggccatcagaaagagagctcaaccctccacggtgggcagaggtcctcaggaagagagcaacctctgagctcctccctccttgatccctgtgccctgtgccttccagcttgtcagctccttacagatgcaattttggacattttatccagcctatttagttgtttcagcaggagggttgctggagagagttatcctcttattactagagagtcccgttgttttaatttgcagtcctttgattagcggtgaatcccagcctctctggtcgcagttccaatttcctttcctgcgaaatgcctgctcaccccctgtgcctctttgctcccggtttcctgcctttctctcattgacgtgaaggtgttccttaaaaactctagatgttaattctgtgttaattgtatataacattttctcctggcatgttatccagccagtcagtgcctttctggtggcctctgctgaacagaaatccttgattttgatgtgggcagattcagcatattctcctctctaaggtctgtgatgtgtcactatcacccttcatgggacacctgggtggctgagtcagttaagcatcccactcttatttcagctcaggtcatgatctcaggggcctgggatcctgccctccagcagggctccatgctcagtgaggagtctgcttgagattctccctctctccctgccactcccactcctgccttttctctctctcaaataaagaaataaatcttttaataaatcccccttcatgattcaaaaccaggtcttccagcgtcatttgacccgcataagtagaggggccctgacctccctctgttgttcactaagcctgtatttgcaccgagtctccagtgttggtgaccttgccacatcactgcctcatttgttagcgtccaataaaaaccaaagtccctgccacatgtggctgtgaggtctacccacccccatcctgtgctccgcaagctgagtctgagacccagagggagaacacagctctattatttttcatcttgagtcagcccaccatccaggctgctaagttatatttggacctcgattctctcatccagtgcttcggctgtcccagttttttggccacctgaaactttggtaaatatgtcatccgttcctccacccaagtcacaggtaagaaggagcaaggagagaggatgaaggccagaaccttggcccacgtccctggagtccttttgggcaggtatcgattaattaatgataacattccccctgagttctccaggcgcaactgagtgccgatcctgcgctagtgctggggaggaggcggcggggcaaacaagtcccccacccttgcagggctcacacactggcggaggaggcagaggcatgccatctataaatgatcacttccactcattctgtgatttcatttttacagagaacccgctcacggaggatctcttttgtgctctgtttgggatgggcaggcacctgggagcaagtggacttagccacaaagcagcccacgtgtcccaagttaccttgcagggcttttggggagtcagccccgcactttgctgaagttcctgcgtggccgggactgggcacctgctgccagcgggacagacctggcccaagggcttcctggcgggtgcgcaccctccccctcataactgctaattctttgttcatcattcactgccagtctcacctgcagtgcctcctgaaaggtctgggaggcacgttctcctgcggtgctggggtgtgattcatcaggacccggagattccagacgggcctgcagtccgctctgtttatctggggagatgtttatcctcctgcccagcaattcagggggcttggtaaagccctcttctgggtccagggtacctcctccactggccagaggcagtgatgctgggcttctccaagtgtgatgggcatgggtgggggggccattgggggtcctgtcccattaatggatgaagaaatgcatttagggcagcccgggtggtgcagcggtttagtgccgcctgcatcccagggtgtgatcctggagacccgggatggagtcccatgtcaggctccctgcggggagcccgatgcaggactgattcccccaatcctgggatcgcccctctagctagaggcagctgctcagccactgagccacccaggcgttcctagcatttccttttaaataaaacagaacgaagagaaggtatcagcgagccctgcaggtggtaagggtacctgctgttttatgaacttttcctttcagttatatattagatctatgtgcggtgggttcagatctaagatccgtcttttactgtgggtcttcatggcagaggttccaaagctacaggcacagtgattaaatccatcctcttgagtctgctagaacagggttcggctctgtgactttggagtctgttacccaacctaagagaatttcatcaataaagcaggattgtcgtacctatctccttgggcttttatgaggattaaatgaaataataagtggaaattgcttggttcagcacctggaatgtaatgtgttccgaagatgggcttgttttcttgctttgaagatatgcacacatggcctggtttccttctcatccccagcgctattaatttcacttcctactttctattttcagcagtttggagaagcaagtctgtggctttctagcaatcctggatttcatggatattatctctcacatctcagagggtttcaaggctcataaacctgcttctcttggggctcgatgcctgtgctgcctgtagtttgggaccggcccccgcccaccgtcctttggaggcccgcctcctgggcccttgttacctctccttccttttcctctgaggaatggaaaccttttcctgtctgtcctcccagaggggtaaactctcccgcattccctgggccgggcctcttttcccttctgccgcctcccggaacccctgctgctcagcccacgccctctgcatccgcatcccggggctctcgctgttcagaccccgagcgctggagacagctggcaccagggtttgagggatccctgagccgggatccaagagccgggtgggcagacggaaaagcccagctcctgccaggagcagcaccgggttggcttgactggttggctttctccccacgtgaaagccccgcagcctctcattcatccgcagccagggctggaggtaccaagatgaacgaaggacggctctctgcgttcaggggctcagtctggagtctgggggtggctcagtgggttaggcgtctgccatcggtttaggtcctggagtcgagccccatgtggggctccctgctcagcggggagcctgcttctctcctccctcagcccctcctgtggcttctgctctctctctctaataaatgagtaggatcttaaaacaataacaataacaacaacaacaacaacaacaacaacaacaacaacaagccctagctcagtctaggcctagtctttaatgcccctccttgaaaaggtttgcatcaagcaatgggtgcagggggcggggatacctgcaggaggtcacccagaagggaacctctaacagtggaaatcacctttcttaacaataaaatttgaattcaaatatgtcacagtttatagtctgatagaagcaggatcaaagaaatgtggaggatgagagtttgcttttgaaaaagcatttcagggactctcctcctcaattgtaaaacagaaaccatccttgtttttcttttcagattacacattgagcgctgggtgtcaggagcggggtggaagccagaacatcccttctgggccacgctgaacacagcacgacacagagaagaccctaggtcatgaagtctgctcctcgtctgggaatgggtccctagctgaccatgggacaccccccctctgttcacaactcgcagataaatataacttagaaaaagtattgctgtcagtacaccaaaatggatacttttcaaatattcccagactatataccattttcagcaatcccattagaactaggctttgattattaaaaatgccaacttgattagatagaaactattttctctcaactttccttttatcacaaaaatgtgataaaatttttaaaaaatattttatttatttacgagagagaacacacacacacagaggcagagacacaggcagagggagaagcagcctccatgcagggagcctgatgtgggactcgatcccgggtctccaggatcacgccctgggctgagggaggcgctaaagctaaaccgctgagccacccaggctgccctgataaattgtttttaatctgtgctttacataccatgtggacctggtgtgtcaaaattaaatttcaagagaaataggtgtatagaaagatcagtggagcagagccctcatcctgaaaacagtacatataaaagatactagtaactcatggttggtacacatatttttcagtattttaatttctctttctgattacaaaatacattagacgcacatgacacagaaagtgagcttctccagtaattccatttccaatatcaaatttcagaaacagttgcctgtctggcccacctcgtagggaacagagagatgccggtgcatgaacacttccaggagcatacgtagaactagaaatgtttggggcgtctgggtggctcagtcagttaagcgtccgactcttgatttcagctcaggtcatgatctcagggtcgtgacatcgagccccgtgttgggctccgtgctcagtgtggtgtctacttaagactctctcttcctctcaaataagataagtaatttctttgaaaagaaataaaaggacaaatgtttgcttccattagatggtttgaagtacttctgcctggggagaatgcagggggcagaggaccttatgccagccttcggggcagcaccctgccagccctgccctgtctctcagctagagctggtgactgggagtgtgtgtgtggggtgttcctccttatgccattcgtcagtctgggactaaggacagggaagggaaagagctgggaggtggcaagcaatcactgcggccacaagaggcgtcaggagaggcaaatgcgcagagagagggtcgcacacaccctgccctcagtgaccttaggagactgccccgtgcaccctgccactggggctgtggggcacctgcgggtgggcaggcggcagtggtccccctggcagcacagagtgactgctcaggatgaagccctccccaagggacatggggaccggcaggttgcgcctccccttctccggttcatgcggtcagcgttagggatgctgggctggtcctccatggtggagctaggctgagacttgagacagatcctccccaccagccgtgctcccccaggtgctctccctccatccctcctgccatcaccatcggtctcctctcaacagggcctgttgcagccaaggcctccgcctcagaccttctgcttagctctcttttgctcaagccgagatgacctcaactcgcaattcccgaaagcacaccaccatttgtggcactgttcaagaaatcctagacaatagagctggggtgagcaattgccatcggagagggcaagcctaactaacgcggggtgccctgcattcaagaagactacctcttcgtcctgcaagtttgggaagtgggtttaactatgtgaggacaggtttcttgtggctgtggggaggatgtgccaacggttttatggatagttgcctcagattgcaggtaaccggcttctgcgagcccccccgcacagccccttccagaggggcccacggaagttgggccatcacaagtttggctgtgtaacaggaatgctttgctacacctccccacttcctctgtcccctgctcctgagaatgtgtgcagcatacgtgtgcgtgcgtgcgtgtgtggaggggcacagggtgctgcatcctactcagagagccgggtatcataggatccctgctttcatcaggcaaatgtgactcagtcgtaccctccagctgagactcactcgcggactacactacctccgcccccattcttcccagaactggctcctgtccttcttttttttttttcctgtcctttgttaccatttcctcgccaacaaaacctggcatgggctggattgtgcccctggaacctatggatgcaaacggatttgggaaagcgggtgtttgcagatgtcattaaatcaagaatcttgagagagatcatcctggattatgagatgagccctcaatccaaagacaagtgccctaggagccatggaagagacacgacaggatagcgggcctgagaagacacctgaggagcctggatttcctgcacgggtggcacaccgaggagcgccaggagctctgggagctggcagaggcaaaggaatcccccccccccccccaggactgagaattcctcctgttttaggctcggctggtggtcatgtgcctgggcagctccgagctgggccttccgggcgcaccgcccccgcagcagcagcgcccttggggtgcccgccccatcccccgatgcgcccttcgccgctgtcctggcccctccagccgttggcctgcctctggaagccttcgcagtctttcccgctgagacctgtcttctctctgcagccaactgcccgaggccccagcgtgaccttcgtgattccccttggtgaaattcatcctgtctcacggctccaaacgccctcggcacacggtggacgctccctatttccctctgcaggaacctggcccagcaggagctcaaaacctatttggaagagtagaaccttttcacataaatcaccattgtaaatgtgtttaccgtagaggggcgcccagctgctggctccactggaggagcatggggctcttgatctcgaggttgtgagttcgagccccacgatgggggtagagatgacttaaaaaagttaatccatgtgtttaccatattcactttggaagcactttcagatatactttcttgctcttcttagaaaagcgctgtggcttttaaatgacccagtgcttgccttcagctattttgtggtaatacccaggtttctggatctttcatgcctctctgacagcctctctgacaaggccggagcacccccggaaggctctgctccactgatcctgcagtggcaagatttctctgcaggaggaatcccgtctagtgactgtactctgactatcaaggcttcctgagaggcttcctctctagaacaggtgttggccacatacaacctgtgggccaaatccagccggttctctgtttttgtaaagcaaaccatacgggaaggcagccacattcatcagggtacatatttctggtgcttctgtgctccaacagcagagctgagtcgcttcaatggagactgcagagcgcatgagccaaacgtttttattctctggccctttacagaagtggcttggcggcccctgctctggaattagtcacagggaaggctttcccctcctgctatgtttgcacaatccgtctcctacatccactctgggagaaggaaggtgtgatctttttctgttttcccacacatcacactcccaggattcgaaatggtatgaaatctactacgtgagtgacagtcttcgtgattgttaaccacctttcttctctcctccctcccagccgaggcctcctcccagagtggtgtgtctggtgatcaataaggctgggattcctcagaaaggccttcccacattggcaatactcccagatccctctcttgtgtggacttttcttttctttcttttattttttataaaagattttatttattcattcatgaaagacaatgagagagaagcagagacataggtagaaggagaaacaggctccatgtggggagcctgacgctcaaccactgagccacccaggcgtcccctgtgtgggcttttcaatggaaccttcgattcggtttggctaaaggcttttccatgcctctggcactcaagacttctctggagggaacattgggtggctcagtggttgagtgtctgccttcggctcaggtcatgatcccagggtcctgggattgagtcctgcattgggctctccacagggagcctgcttctccctctgcctgtgtctctgcctctctctctctgtgtctctcatgaataagtaaataaaaatcttaaaaacttctctggagtatgaatagcctgatgagtgatgacatggaactgctccctgaaggctttcccacacccgccacaggtaaaaggcttttccccagagactactcaagaggaagcaagtattgggagctttgacatttgtggggcttctcttcagggtgaactctatggggctcagtagttgatataatccataaaagctcctctacccttgctgcacacatgtggcctatccggggtatgaaccctctggtgtgtgatgaggtgggacctgtctctttgaggcctctacagcttttttctagcatgcaccgtgtgatcaacaacaaaaaaagcagcctcctgagcaaaggcctctttgcgctcaccaatacacacatacttcttcccatcaggaagaaaaggagaaagggcctcgttgtcctggaaggttctcacacttgttacatttatggaggttttttgattacaaagtattgatgcgaagcctgaatgactgactcctggtacttcctctccatcctcagcactcaggagacttctccccacgagtcggaagctgggagctagagctaaaggttttgccacattgcacttgttcacaggccttctgactgtcgtggatggtcacgggcctgcacacaagacttcccacacctgccacagaagagggctctctctctgtgagcaaaaacccacctgaggacagaacaatcaaagagagaacggaggcgtgtggccctcattctacctacccttcacagcaagggagggaaggggcctgggatgcggcaggagccggcaggcaaagaaggcccacggtgctgactgataacatgcagagactaggagggaggaacacaggcctgggcaaagacgcagggaatgaacagggaagtcagctgatgggtagaggggaagtcaacccccaggaggacggggtaagaaaacaaagctgcaggaaaaggggtacggctgtgggcggaggtcctcggtgtcttcagcaactggtcggtagaggcatggcaccagccagcatcctctgggtgccgagggctaacccaggggagaggagatgggcaccagcgtattaccgtattactgtggaggtttctatcagatttccacctactggctaagagactgagagaaaaatgaggagtcacctaaatcggggctctgccctcggtgcgtcaatgtttcaaaaggcacaagggaaggcaatgccacaaggaggggtgctagtgggctcccctcactcagccatgcaggtgaagccctccatcctcagtggccagcagatctggtacctgccatgcctctccttgttcccggaagatgatcagatcaggctaggaaaaatgaaatcctattcatagcactgaaaacaggaaaggggagataatgggcccaaaccaggcttagtccttctgccaacatgaaatagatatggccaggggctgctctccaagggggggaccatctcaggccagaagtaaaatgcccatgggcaaggtcttccatacaaaggcagatcactgggtgctggagagcatagactcagatcacaggaaaggtgcccatttccagtaagggagatatcacagtatgacgtttatgggaagcaaaaatagtgcacttttcatcaggagggagcatgcagcttacaaggattcagaagctaaaatcaactaaactgaaatctttattttatttgtttattcatgagagacacacagagagagacagaggcagaggcagagacacaggaagaagacagaggcacaggaagaagcaggctccatgcagggagcccgacgtgggactcgatcccaggtctccaggatcacaccctgggctaaaggcagcactgaaccgctgagccacctgggcttccctaaactggtctttagaccatgctgctaacaaatgggtggtgacaatgacttagcagtggaggaacagagtcacacagagagcccttacccaatcagatcacattcccaacattctccatcacgtcttaaacggagattcctctcagaagggtcacacaattccagttcctatgagcgaagtgtatggccatggcctcacacatcctcaaagatcacccaatcctgaaacacaggatttctgctgtcaccagaagaagaatccttggggaattattcagcaggataaagaggaggctctgagtctgtgtttatacctgatgagcaaggacagatatggaacaagacaagggtcttccagcagggaagggagtggttagggctgctgtgtccagcaaacgccacagcaatgaaagtgcaagggaaaactgtatttccctcccctactctcgatacttctggtcaccaaatatgtgtgtaggggggtgttcccacaccaaacagttctctgacaccagctgggtgtccctcaattttttttaaagatttaattttgaaatttttttttcttcattttttaaattttattattatttattttttaaaggaatctccacatccaacatggagctcaacctcaccatcccaagatcaagagtctcaagctccaccgactgagccaggcaagtgccccaagagagtggagagagcatcagatccgataggtgaagggctcagccccaccaggctgcctccacttcagatgctaatcacaagtccaagtcgtcacctgcacttctgattgaatggctaaaaatcagaggttcctatgaccctctcctctcctcagattcaatcaatttgttagagccactttcagaactcaggaaaacagtttacttatgattgccagcctattccaaaggatgttaaaagatatgactaaatggctagatgaagagtgtagatacttctgtccccagtggacttaggctgtgtcacctccttgcagaaggatgagccccaggaagagctcatcaaatctcactgcccagcagttcttatcaggcttaatatccagccctctccccttcccataggttggcaggtggggctgggaattgcaatcctccaactacttggtctctctggtggccggtcccatcctgaggctgtccggggaccctacctgccctaagtcccctcatcagcataaactcctgtgttcttggaaagggactccttaagagtaacaagagacaatcctatcacccaggcaagtccaagggttttagaagctcagtgccaggaatcagggctgaagaccaaatatatttattataccgtgggagggaatgcaaattccaattgattaattcgccagccaaggtctcccgaaggagcagaggaaacagagcttaccagatccaagtgctagggctgcagccaccatgactgggcctcaggactttcttctgcagagggtgggggcttcagggccacaatgggcaagtttctgaggaacacacacacacacatacacatacacatacacacacacacacacacacacacacgagaggcagccctctaccttgtaccctgacccattcccaatgcccacggagggaccaaacacacagaacaggaatatttacagagggggagtgtgcacagccctgtagttctgaccctgcattcaaatctgcttcagaaaccaggctttgaggcagcaatggacagtaagtacccagcatccctcatgtggaagacaagtaggcttcactctagaatttaaaaatcttcccacatgtaccctaaccatcttaacttgggccgctaaataagtaaacagctaaaagtatcgcaaataataaatctccatcggtcagatggatatggcatgtctctgctgtgaaatccatgagctataaagagcataaagtagacttacatggaaagacctggagatgtttcatgatgtagtaaggtgctataagtggaaaaccaagatttggcttgatccttttaaaaaacacatatgcttggggcacctgagtggttcagcagttgaacagctgcctttggctcaggtcgtgatcccagggtcctgggatcgagtcctgcattgggttccctgtgggaaggttagcttccccttctgcctatgtctctgcctctctctctgtgtctctcatgaataaataaaatctctaaaataagtaaataaataaaaccaaaaacatatatgcttacctaaaatctggattttattctaaattctttcaaaaaaggatttaaaaaggtatccattcactttccacatttttacacaaagagctttatgaaaaacattttctctcaaattcttttattatgctaagtaatatataaacataaaatgtatttcttgatttttatttatttatttatttatgatagtcacagagagagagagagagaggcagagacacaggcagagggagaagcaggctccatgcaccgggagcccgacgtggaattcgatcccaggtctccaggatcgtgccctgggccaaaggcaggcgcttaaccgctgcaccacccagggatccctatttcttgattttttaaacaatagcaaagatttatttttcactcatgttatagaagggctgtggctggctatggctttgctccatggcactcaggctgaaagaaccccaacaaaactttctcatggctgagcccaaccagcaaccactttttttttttaagattttatttatttattcatgagagacagagagagagagagagagaggcagagacacaggcagagggagaagcaggctccatgcaaggagcctgacatgggactctatcctaggtctccaggatcaggccctgggctgaaggaggcgctaaaccgctgagccaccctggctgccagcaaccactttttaaaaagactgattgattggttgatttaaatattttatttatttgacagagagagagagagagagcacaagcagggggagcagtaggcagagggagagggagaagcaggatccctgcaggagcagagagcccggagtggggctgaatcccagaagcctaggatcgtgacctgagcagaaggcagacactttaactgacagagccactcaggtgccccttaaagatttatttgtttgagggagagagacaatcagagaaggggcgggggaaaccatcttcaagcatactttccactgagcgcggagcccatgtagagtccaacacggggcttgatctcaaggtctacgagatcatgatctgagctgaaaccaggagtcagatgtttaacctactgagccacccaggtgtccctcaaccactctttttttttttttcaactcttaaaaaaaagttgtggtatgatgtatagaacataaaatttaccgttgtagtaatttttaagcatacagctaggtagcattaaggacattccagctgctgggcaaccatctccaacatccatctccagaacttttctcatctctcatctacccaaactgaaactccatatccattaaataacttcctcccagcccctggcaagcactgttctactttcctttaagaatttggctcctcaggactcccgggtggctcagtggttgagcgtctgcctttggctcagggcatgattcccaagtcctaggattgagtcccatgtcaggctccctgcatggagcctgcctctccctctctgtgtctctcatgaataaataaataagatcttaaaaaaaaaatttggctcctcaaggtacttaagtggagtcaaacagtatttgtcctctgtactgtcttactgcactaatataatgtcctcaaggctcatccccattgtagtagcatggtcagatgtccttcctttaaaagtctgagtaacagtccagtgtacagatactgtgtttcatttctccagtcccccacgggtggatcctgggttgcttccactttctggttattatcactaatgctgctataaacatgggtgtgcaaataactagagtccctatttccaattcttttggaaatataccaggaagtagagctgctgggtcatatggtaattctaattgttttgaggaactgccatgacattttcagagtggctgcaccattgtacattctcaccagcaatgcacaagggttgtgatttctccatagcctcacgccaacatttgtagtttgttttttctggtaatagtaattgtaatgggtatgaagtagcatctcactgtgggtttgacttgcatttccctaatgatgagtgatactgagcatcttttccagtgcttattttgccatttgcatatcttctttgggagaaatgtctattactcaagtccttggccccctttttttttaactacttttaaaaatatatttatttattcatgagagacagagagagagagagagagagagagagaggcagagacacaggcagagggagaagcaggctccatgcagggagcccgctgtgggactccatcccaggtctccaggattgcgccctgggctgaaggcggcgctaaaccgctgagccacccaggctgccctactgtctacttctgtatagtgatttagtgtttacaaagtacttttatgcgtattttttgataaaatagaattttatttaaattcaattaacatatagtgtatactccagttacccgagcccccactcccctcccctcccacaaccctatttgtttcctatgattaagagtctctgggacgcctgggtggctcagtggttgattgtctgcctttggctcagggcgtgattctggagtcccgggattgagtcccacattgggttccctgcagaggcctgcttctttctctgcctgtgtctctgcctctctctatctcaggaataaataaaacctaaaaaaaaaaaaaaagaaagagtctgttatggttcgtctccctctctgatttcatctttttattttttccctcctttcccctataatcctattttgtttcttcaatttcaggagtgagatcataattgtctctgattgacttctcttagcataatactctctagttcatctatgtgattgcaaatggcaagatttcatttttttctgatggctgaatagtattccattgtatatagatacacatcttctttatccattcatctgtcgatggacatctgggctcttttcatagtttagctattgtggacattgctgctataaacactgggatgcatgtgcccctttggatcactacatttgtattttggcggtcaatacctagtagtgcaatttctggattgcagggtagctctattttcaactttttgaggaacctccatactgttttccagagtggctgcaccagcttgcattcctaccaacagtgaagagggctcccctttctccatatccttgcttggcccgttgattaatgggagttgtttggttttaattgtaggagtattttatttattagtttatttatttgagaaagagagagcatgtgtgaaatagcaagagcacaagggagagcagcagagggagaggcagagtgagagagagaagcagactccctgttcagaagggagctcccttctggatgttcagaagggagggatcctgatgggggctcctcacggggctccatcccaggaccctgagatcatgacttgagcagaaggcagatgtttaatcaattgagccaggcaagcatccctaattgtaggagtattttgtatatttttggatgactttcaatttttaaaaactttctaaaaaactttttgcacagggaaccctgggtggcgcagtggtttggcgcctgcctttggcccagggcatgatcctggagacccaggatcgaatcccacatcgggctcccggtgcatggagcctgcttctccctctgcctgtgtctctgcctctctctctctctctgtgtgtgactaccataaataaataaaaattaaaaaaaaaaaaactttttgcacagaaaatgcctacaattcaagaatactgtttacatttggattgggattttggagatttcttagttttttttttaattttgaaatggcatatctcaaaggatcctagatgtttgcgtctggagttagaacagcatcacaggctgaatgtaaaggcagaataaatatgcaaagctaagcaagagagttagtctcttagcccatctctgcccctccagccctccgccatggtcacttcacaaatcagagtgggaaaactctagtagagagaatttgcatctgggaatagtgacaagggccatcacttcatatatattacaaagttattttggttttactgagaacatcctcagaaaaaatttctacaaagggtaggcagtggaaatcatactttcttaccaaaaatgaactgtgacaattaacaggacagttttcaaaaagctgcttcaatgtgatctgagcactctgtcagaggctgctagtcacctataaacacctctctcttctttcctactaacagaaacacattttttaaaaaagattttatttatttatccatgagaaacacagagagagaggcagtgggagaagcaggctccacacagggagcctgatgtgggacttgatccccagactccaggatcacgccccaggctgatggcagacgctcaaccgctgagccacccaggcgtcccagtacagataatctaaataaatttattatttaatatttaaataaatttaattatttattatttaatatactattatatttagattatattaaatttaatataatattatttaaatttttttttccaaaaaaaaaagtaattgtctacttttgggtgtgggctgatgagaaaatagggaataaagtaaatgagaccttgcttaactaatggtgacaagagacctcaaatggagtataatttgcacaccctttacttctaaggttcaaaaaacttccagctcacatcacatacatttttgattaaacatctactcactggcttgagttaagtccttggttttcagatttactaaataacttttggctacattttaaaataaaaggatccttaagagataaagactagtcacatttcaggctcacatatatgtatccattgcaaaggcagctcaaaaaacacttgagccagcacagtaaaactaaatgaagtaggtagggccttccaggatccctcctttaaggggaaaatgttgaaacacacacatttaaaaaggaagcaatgcagcttcctgttgtgtgcactcccttctctccctttccttcttgcacggctctccacactctgtatataagaatatttcaagaactaaaacacacacacacacacactaagctgtcttttgaatacagctaaagttaaaatgtgtatgtaacaatccaaattggcaaaattcaaactaaactaaaactgtaacaggagagtggctctgtagatactagcatattgatgccacccagtgaaattcaataatgcccacatctgactcacttacacataaattcatgagggaaagaatttttatcttttctgttcattgatgatctcaagcatctagaacaggatgtggcacataggaggtgtgggggaaaaatttttttggaaggactacatagcaataaacaaagtctctgcttgaagtaaagggtattgaataagttcccactaatctgtgtactcatctaagtgtataaagtgaatacaaatcttatcaatcaaatacttagatgttacaaacacatggattttccccacacaaggcaatgagatgtaaattatgggggtgggggaaagatgacgaggcagcatgtacacatgatggacaactgtgaggatattcaggtgccagaccatggggatgagaacaggcactcaggacccaaagagtggaaggaaagacaagattaatcacttgcaaactcacgcacctcaggctagatttaaaggtgaggatcagaagaccccgatgtgcgtgatttgggctttgtctttgatgtaacttggaaagctgtgatatagacaatcttattcaaacatcttcaaatctgtattaacaggctaccacgtagcttgctgatacgggttattaagatcaatgtccctttttttaaattctatgatataatttgactttctatatcctttttatagggaaatgatgtgtgcccaacttgcagaaatagtcttgttcgcttgccagatttatttctcattgtaaattcacatgctggctaattataacagcttggaagttacataaatgtccaacaatagggaattggttaagaataaaattcattatagtgcatatgtataagacaacgcagccattaaaaaacatgatgtaaaagtagattattgcaacaggaaaatatccacaaatagagggcatataaaaaatcaggttataaaacagatgcatcaaataatcccagctgtttaaaaaacctactcaagagggaaaaaaaaacctggtagaattttactaagcatagggttatgtatgccttagggtacaattagagattatctgttttattctgtagttttataaatttaggtcttatttttctgtattttccaaattttctataactgaacaataattacttctgtaatcagaaaataagcagcaataatttctcaattttcactcatatgaccttagggaagttaatcagcgtgtctgtgctggtttttttacctgtaaatggggacaaaagcaccccagcccttagattactagaacacgtaaacccttataacagtccctggcaagtggaaattgcttagtaaaggttggctattggctctgaaattcttgcgagtacggggttatgtgcttgaggaccaggcctgtctcacctgtggggactctccttgtaaagtcagcctaagaagcccataggtgctttcagctctttctactaacagctaacagaggtagaaagggaaattgagggctgagctcacaaattccccagtctctaggcaccagggaagaaatgtaaatgtgagtgaagcagctgggaatctgacaaggggggggggaccctatggctccccagagagggtaagactccccaaaagtagctcaattcagcttatttaatttaattttatttattttaatatattttttttagtttttatttatttatgatagtcacacagagagagagagaggcagagacacaggcagagggagaagcaggctccatgcaccgggagcccaacatgggatttgatcccaggtctccaggatcgcgccctgggccaaaggcaggtgccaaaccgctgcgccacctagggatcccagcttatttattttatatacacatatgtattttaaaagattttatttatttattcatgagatgcatacacacacacacacagaggcagagacataggcagagggagaagcaggctccatgcacggagcctgatgtgggactcaatcccgggactctgggatcacaccctgagctgaaggtgggtgctcaatggctgagccacccaggcgtccctacatatatattttaaagatttatttgagaggaagcacacaaggtgaggagaggatagagggagagggaggaagaaactcaagcagactctgtgctgagcaaggaggctgatcccacaacccatgagatcacaacctgagtcaaaatcgagttgtacgctcaaccaactgcaccacccagacactgtatttattttttaaagattttctgtgtgtgtgtgagagagggggagagagagtatgtggggggagggggggcagagggaaagagagaatctccatcagcctccatgcccagcttggagggcccgttctcacaaccctgagatcatgacctgagctgaaatcaagagccagacacttaactgacccacccaggtacccctaaacatttcatttttaagtaatctctacacccacctgagggctcgagttcacaaccccgatatctagcgttgcatgctctgctgcctgacccagccaggtgccccagttcagcttattttaaaagcctgcactggcccaacagcacatctgccctggagctgcctgaaccgtgcattaaaaagtatccacagaaggtgcacctggtggctcagtggttgaacgtctgctttgggctcagctcatgatcccagggtcctgggactgaatcccacatcaggctccccatggcacgctctgtgtctcatgaataaataaaatgttccaacaacaacaaaaaagtctcacagaaaagaatttaaagtgatggggattttagaggttgttaataagccactccagtcaatgcttcattctctttagggtgtttatgactgggtttcaaatatttgtcagtgttccctcagggaggaagttgttaaagcacacagcaacctacagttcccatactcacatgccagaggctgtattaatgatggaaaccaactgtatgacctacctgtggtgagagagattccaaagcttgcctgttgaggggtctgaaggcaagtcagtctgactgattccggcctgaacgactgaagaggtaattcagagagtaggaactaatccttcagcaaatgtgagctgccttagaactccagggaccatataatttgttgtcacaatggggatacttcttacctctgagagtggaagggaatgctattaataattacaccaggacactgggtcttgactggaaatgcctcaaacaaactgggatatgcggctacccagttaaaatcaaagcattccctgaggccttgggtaaattccagctcttcacctgaaaaccatctacttacgtggcaggaagaaaccactcttttcaaaccactgtttactagaaaataatccagaagacctatttcaagggcttactacccacaagagtttgggatcttcatctctgaaatccctggactgaaagcagagaggctttacaaccaggatgagggcccagcttcccagagctgatagagtgaaaagtgtttcagaaggaaaggcaggaaaggttagttgatctctcagtccctggtcctccagagatccctgacaccaccccagcctcagtgaggaggggagggagggagctattctgagtagcagctccatctgaactcagcagggtcagagtctatgccaccagtgaacctctgttccccttttcccactggactccaggggttacagccgcaatataatgtcagaagccacagatacaataatgacaggaggccatgatttcaggccaaagaccacgtccatagctgacaccagatgggacttaaatttgatgcatgttctaccaaacaagtgtcttctgcattctacagatggaaaacggactcctttacattcccatggtctttttgacaattatcctacccagcccttttcctatgttgtgaatttttagcttcttaaatttgcctctctcttccctcctcctgtactaattaacagaatcccaagtctggctttgaaactacagaacttcccaactaccggtgaaaaaagtctcagcgaaatcgggaggaaaaaatatttctctcttctacagctgcagaaaagcaagcaccatacaatgtcccgaaagtgttcttgctgaggttatttttaaggagtctttcaaactcctggacttcagacacttactacatcctgggaaagtgatcttcaaagtctgtaaattttaaagaatttaatatcgacgattctgattggttacttcatttgtaatcctgaggggcacctgggtggcacagtcagttgagtgtccaacactagatttcagctccgatagtgatcttagggtcatgaaatcgagccccacatcaggctctatgctcagctcagagtctgcttgatattctatctccctctgcccctccccccacttgcacacattcgatctctctaaataaataaaatctttaaaatgataataataataatttgtagtcccagtagcactatttcaatagatatggtaggtttttttggaaggtgtgattttttcattcttaagccaggaagaggttcattactagcaactttgtctattcataagagcatggagataaaaaggaataaaaacagtggctttattggattttgtttttaaagagaatttgacaatcaaatgtttaaattaattttatcagcaataaagcaccaactgtttcaatgtctgatggttgaagttattctttttgcttttagcaaatctgtaagaggactgacccaagctgtctgagtcatagggagtgcatcaatcctacactggggccaggtatcaagccccagcaaccagaagttgaacaggaatgggctcttggcccttcaagcaaccaggaaaggtcttcaccttctataggcaaaacagtctgtcctcttcctgttcactgggatgagaagtcccagtaatttcactaagaggacagaggtgaggaaggagggttggaggtcccactgccatcaccgagaccttttctcagtccaaagtcagaataggggccagattcagattggtgcttatttgaacatgagggttctgagaatttgagggggtccagatccaaactcccattctctactctgcctccatttccaaagaaaaatgaaaatgcagattctaaatagaacacataaaaactgtaagtgctatgaatacctggctggctcagtcagcagagcatgtgctcttgatctcacggtcctgagtttgcgccccatgttgggcataggttacttaaaaaaaaaaaaaaagttaattaacaacatatgaaaagaaaacctttaaatgctactacactctgctcacttagaaatcttaaatccactgggacctgaggagggtgggaagaaatccatcttaagtcttccttcatagtgactctgaaccagagttcagtgctgagggaaaaggcttggatagtcattggtaatagtaaaataaaccaaactatataaataaaataaaataaaccaggaggagaaaattaactgggatgaacctaattcttaacaagcctttagaattactactataatgggtataagttgaaggcagacaagacaggggtcccaaaggccttcttgcacgtacctggctatggttttgtccagtccagatacacaaggcttccccactttccaaatagcttactgcttcagttttatagactgaaaatcctatttatgggcaaggaaaagggtcagcatgttaaggaatcagggtatgagggcaactctgctgacgaaccccctaatttcatggctccaggcaggcaaactgtcctcctccttgctcctgccccttggctccttctcactggctccagatattccatttgcttccttctttcctatctttccatgaccaactgtagacttcccagcttcccactatcttgctgtccttgctaacctaaaataagcttctcagatgaaggtttttctgctgatcaccagagaaatacagaaaatgggtagaaagcctgggctatgtttctggcattccagataccctgggaatctcttttctgccactttttcatatcaaggttggatttcaactccatccattagtacatactttttccaacatttatactgggggacttcttttgtaactacgaaatatgggggtgggggtgggggctgagaaactccagatgcgaatctttcaccttaatagccctccaaatttaatctaattaaatcattctgatgacagaggattatagtgataaaaggaactaaagaccgattccctgtattcgagagaagttggagaaatatgctctgaggggcataacatactctgaggctgggatggacctggcaggcaaatcctttttgtgcctctggaatgaaaaaaaagacagtggcagtgggcagctgccctagaaacctacgggtcagtcccaggcctgggaccctgacccgtggagtgcttacacagaactctagctgtgagaaaggtaagaactgacaaagctcagaagattgtcaactttcggggcgcctaggtggctcggtacattaagcatccgtctgtggatttggctcaggtcatgatgtcacagctcatgaggccaagccccagcgggtgcttggggctcagtgggggcacgcttggatactctctccctctgcccctttcccactcgtgctctcttcctctctctctttttttttttttaatatttttattttttatttttatttatttatgatagtcacagagagagaaagagagagagagagagagagagaggcagagacacaggcagagggagaagcaggctccatgcaccgggagcccgatgtgggactcgatcccgggtctccaggatcgtgccctgggccaaaggcaggcgccaaaccgctgcgccacccagggatccctctcttcctctctctcaaatgaatcgaaaggaaagaaaggaaagaaaggaaagaaaggaaagaaaggaaagtaaaggaaagaaagaaagaaagaaagaaagaaagaaagaaagaaagaaagaaagaaagaaagaaagaaagaaagaaaaaaaaagaaaggaaagaaagaaagaaaaaagaaagaaagaaaaagaaagaaagaaaagaaaagaaaagaaaagaaaagaaaagaaaagaaaagaaaagaaaagacaagaccaaaataacaaccaaaaacagaagaaggttgagctctgctatccagaaagttctggaagctctccagaccctgaagcgttccacaacattggaaacggaaaatgccgaaaatgccgagagaggtccacagttagtgagaagccgcaatgaggccttccagtcgcactgcctgggggccacaggggtgtcctgacccggcgcccccgccccggcgtgtccgtgtcaaaggccttcccaggccagtccaggtgactccacccttggtctctgaagcccacgtccgcatcatcgaaggtcacggcccctgcaacaggttggtccgctatggcccgggtcgtaccaacacttgctcctcgaaggggaaggaggcctgggaactcgaggggacggaggtccggcggcgggcgcggggagcggaggggcgccgaggggggcaggccccgaccaccgaccacagaccaccgaccacccgggcatgacccccgcccgaggcctcggaacccgcacttactgcgctggggccacgctgcaccgccaaggcgaggtaacgggagaacagagggcaaagcgcaggacgcgcgccccccgcagcacagcactcttcgcgccgaccctcagccgccgggtcaccgcggctcgcccgcgcgcccgccggccctcggccccgcccctgcccaccgcggcctctctaggctgcgcggaggacctcgcccctcgctctcggtgggccgctccctgggacgtgggtagcggggcggcctgggaccgccaacaccgcccgggagggtcctgggcgcttggccttccactcctcacgttttacgccagtcatctttaaaactcccttccccccattctctttccaactaaagagagagaggggggcgcctgggtggctcagtggttgagcgtctgccttccgctcaggtcatgatcccggggtcccgagatcgagtcccgcatcgggctccccacagggagcctgcttctccctctgcctgtgtctctgcctctctctgtgtctctcatgaatgaataaataaaatcttttaaaaagagagagggagagaaaagcctgtggcacaccaaatatatggaaataattactgttaacattttagagaattttactcctataattttctacatatagtttgatatttttgtgtttctgtcgtctccaacttccccacttgattttgtcatataagcactctctccccccatattgtgacccccgttgtgatactcttaactggattatcatcgtggattcattctatatcaaatcactcaaactgagcccaggaaaccagccttccactgaatggcacacctagtggcatctcagcctgtcctcggggaagtgctatgaagttcaccactgtttatctctgaggaggactgtacttttgttacacagcccctttctgtaatcactcaaaagaagacatttttatggtcttgctatcaagaaaagtttaatagagcaactggttagttttggcctatggactcagggagttttgaatttgagttgagtaggctattagaaagctagccagggagaggcctgggtgactgagtccgttaagtgtttgccttccattcaggtcatgatctcagggtcctgggattgaggggctccctgctcagtggggagcctgtttctccctctccttctgcctgctgctcctcctgcttgtgctctctcattctttctgtcaaataaataaataaaatcttaaaaaaaaaaaaaaaaaagaaagagagggatggctgggttgctcagcggtttagcgcctgcctttggcccagggcatgatcctggagaccccggatcaagtcccacattgggctccctgcatggagcctgcttcttcctctgcctgtgtctctgcctctctctctgtgtctctcatgaataaataaatacaatcttaaaaaagagagagagggcagcccaggtggctcagcggtttagcactgccttcagcccagggcctgatcctggagaccagggattgagtcccacatcaggctccttgctcagagcctgcttctccctctgcctctctctctctctctctcataaataaataaaatcttaaaaagagggagagagagagaaagctaactacaaattttacctaacgattaaggggaccagtaaatgcaagggtaactttttacccaaatctattctcagaattcaacctgctgccatgtttctttttcttttttttttttaaagattttatttatttattcatagacacacacacacacacacacacacacacacacacagaggaggcagagacacaggcagagggagaagcagactccacacagggagcccaacgtgggacttgatcctgggtctccaggatcacacccagggttgcaggtggcgctaaaccactgtgccactggggctgccctgctgccatgtttctatagataacattcttgcctggcataacaatatggtttagttattttgcagagactcaggtttcagtagaaacccatcagaacaagttaggacccccaaccttctcttggagcatgcaccaatgtctgatggatgaatatttgatatagaagggcctaaaaccctaccctggaatcataccaagtgggctattttctcatcatgagtcatatgaagaggcaagcagaagatctgtgaagatgctgacagtgagatcacttcaacccttcccttacttatttatttatttatttatttatttatttatttatttatttataaattttatttatttattcacgagagacacacagagaaaaagagaggcagagacccagacagagggagaagcaggctccatgcagggagggagcctgacatgggactcaatcccaggtccccaggaccacaccctgggctgaaggtggcgctaaactgctgagccacctgggctgcccccttcccttatttatgaactccctttatgtgattttttctttaatttttttttcatttatttatgatagtcacacagagagagagaggcagagacacaggcagagggagaaagggagaagcaggctccatgcaccgggagcctgacgtgggattcgatccggggtctccaggatcgcgccctgggccaaaggcaggcgctaaaccgctgcgccacccagggatcccctcctttatgtgattgtaaaatcatgtagctcctcttccctatacccaggtcctttttcatttacctttaaatatccctgactcttcccccttgaagagaggattttgagggttgagttcccttctcctttgcctttttttttcttttcttttcttttcttttcttttcttttcttttcttttcttttcttttcttttcttttcttttcttttcttttctttctttcttttcttttctttcttttttttttttttcagataagctcaatgccaaacctggggccccaactcatgatcctaggatcaaaagtcacagtctccactgactgagccagccagtctcccctcctttggctgcctcttgaataaactctcttcttgctgcatacttgatatctcagtgattggctctgctgtactttagtcatatgaacttggattggtcacaaatttggtgagccagccaggagctctttgatcttggttccactgcaccagcctattaaagggagtctggtgaggagtccaagaagccacataggctctttgtcctggggccacaccccaatttgactccactgacctcaggcgcttaatttaactcttctgggaaggaaatccctttggtttccgtatagacagacatccctttagtgagtaactcagtacaagtgaccaaattctttcttcctctcatttggtggaatgaatagggggtttggctttagatctcttggcctttttcttgtttacttaagaaaaggttgactagcaaaccatttactcagttggtaaagccccaacttttagaatgaaactagtgaatctttgttcacagaggtactcttggcctcatttgttcctgcagtttgtggtgtatttgaataaaactggctgtgttctaattgggaaatggggaatgacaatttgatcactgcatgcagccctttggattatattctcaaaaattggacaatgtttagttgtgaacctatgaaaaggaaaaaaaatgatcttttgcaacactgcttgactacaatattcattagactctggaaaaaaatagccaattaatggatccttaaattataatatcatcttgcaattagatttgcctttgtaaaagggaaggtaaatgggatgttcagtcattttttgcttttgtatcaaataagccagctcagaaaagatgtaaaattctattccaacaaaccagtaacactaaaaagcccgtgttgcctaatcctcaccagggagaggaggatgatttattgattacgtggattaaactccccttctactctatggggggcaccagagctactgcctgtcctcagcagtcccagtcccaacaacttgaaccccttacagagcccaaaccatgacccttagcctcagggggccaacaggtaggaatgatctccccttcttataccctaactcaatttggtcaaattgagctagttcccagggaggataatatctgctaaggcaggtcccagtctgaggcttaaatgcaggggaaagggggatttcctgtagggatgatttgggtccactctccactttgtgtaactggaaaaacaatatgcctacttacagagatgaccccaagaggatggaaattcattcacatctatttttgtcacccagaaccccacttttgcagatatacaaaatttgttaagtattctcctcacttctgaggaatgacacttaatactaaaaaaaaaaaaaaaaaaaaaaactagggaagttacctggctgcatgctaaaacccccataactccctaagagctaatgccatgatgcctgttcctactgtaaatcccaactggaatgtcaacattggagaccaaggtaagtttgaatactattggtggtattttagctagattaagaaagggggttcccacactgtgcagaaggtttttattttgatgtagtctcaataatttaattttagttttatttcctttcctgaggaaaatgtatctagaaaaatgtttctgtggctgatatcaaagaaattactgcctatgttttcttcatgttttatagcttcaggtctcacacttaggtctttaatccattttgagtttgtttttgtgtattgtataagaaagtggggggtgactggctggcttgctgagtggagcatgtgactcttgatctcagggttgtgagttagagcccacattaagtgtagagattacttaaaaataaaatcttaaaaaaagaaagaaagaaagaaagtgatacggtttcattctgttgcacgtagctatctagtttccctaacaccatttgttgaagagacttttcccattgtatattcttgcctccatggtcatagattaattgaccatataagcatgagtttagttctagactttctattctgttccattgatctatatgtctatttttgtgcagtactataatgtttgattactacagttttgtagtatatcttgggatctgggattgtgatacatccagctttgtttttctttttcaagattgctttggctatcttttagggtcttgggtcttatcttagggtcttttgtggttttatacaaattttaggatttatttattctagttctgtgaaatatgatgttggtattttgataggagctcattaaatctgcagattgctttgagcagtatggacatttcaacaatatttgtttttccaatccatgagcatggtatagctttgtttacatttgtttgtgttatcttcagtttctttcatcagtgttttatagttttcagagtataggtctttcacctccttgtttaagtttattcctgggtattttgttctttttggtgcaattgtaaatgggattgttttcttaatttctctctctctttttttaagattttatttatttattcatgagagacagagagagagagagagaagcagagatatgggcagagggagaagtaggccccatgcagggagacccatgcgggacttgatcctgggactctgggatcatgcctcaggctgaaggcaggcactaaactgtagagccacccaggcatcccattaatttctctttttactacttcattattcgtgtatagcaatgcaactgatttctaggtattaatgttgtatcctgtgacattactgaattaatttatcagttcctgtatttttttggtggagtctttagggttttctatatatagtatcatgtcatctgaaaatagtccaagttttacttctttcttaccaatctggatgccatttatttctttttcttgtctgattggtgtggctaggagttccagtactatgttgagtgaaagtggtaagagtggacatccttgtcttgttcctgacctgagagggaaaagatctcaggttttcaccactgagtatgatgttggctatggatttttcatatatggcctttattgaggtatgttacctctaaacctactttgttgagagttttcatcatgaatggatgttttactttgtttagtgctttttctgcatctattgcaatgatcagatggtttttaccctttctcttgttaatgtggtgtatcacattgattgatttgtgaatattaaactactcttgcatccctggaataaataccacttaatcatggtgaatgaccttttaaatatattgttggatttagtttgctaatattttgttaaggatttttgtatctatgttcatcagagatattggcctatagctagcttcctttgttttttttctttcttttcttctttctttctttctttctttctttctttctttctttctttcttccttccttccttccttccttccttccttccttccttccttccttccttttttcctttctttctttctttgcctttgtctggcttttgggaaaattctggccttgtagaatgaatttaaaaattaaactacaccaaaataaaaagcttttatacagtgaaggaaaccattaacaaataaaaaaactacctacggaatgggagaagatatttgcaaatgatgtatctgataaagggttgatactgaaaacatataacttcttcaactctacaatatatattgaacttgggatgcctgggtggctcagcggttgaacatctgccttcggctcagggagtaatcctggagttccgagattgagtcccgcattgggctcccagcttctccctctgcctatgtctctgcctctctctttctgtgtctctcattaataaataaataaaatcttttaaaaaaatatagaatttatacaactctacacacacaaagatacacacacaattcgattataaattgatttataaatataaaggcagaagacctgaataaacatttttcaaaagaagacatacagatggccaacagatacatgaaaagatgctcaacatcacttatcatcagggaaatgcacatcaaaagcacaataagatatcattttacacctgtcagaatggctaaaatcaaaaacagatgaaataacaattgttggcaaggatgtagagaaagagaaaccctcatgcacagttggtgggaatgcaaatcagtgcagccactgtggaaaacagtatgaatgttcctccaaaaattaaaaatagaattaccatacgatccagtaattccactactgggtatttacccaaagaaaacgaaaacactaattcaaaaagatatatgcacccctttgtttattgcagcattatttacaatagccaagatatggaagcaagccaaatgtccatcaatagatgaataaaggcacctgggtggtgcagttggttaagcaactaactcttgattttggctcagatcatgatcttggggttgtcggatcaaaccccacattgggctccaccctcagcaaggagtctgcttgagattctctcttcctcttccactgcccctcccactcatgctctttctctctcataaatatataaatctctaaaaaaagaaagaagatatgatatatttatacaatagaatattactcagccttaaaaagaatgacaccaaaggaaaaaaaaaagaaaagaatgacaccttgccatttgcaactacatagatggacctagagggtatgatgctaagtgaaataggtagattggtcagagaaggacaaataccatctgatttcactcatatgtggaatttaaaacacaaagaaaaaagagacaaacaaaaaacaaactttttaaaatagtttttctttctttcttttttttttaagattttgttcatttattcatgagagacacagagagggagagagagaggcagagacacaggcagagggagaagcaggttccatgcagggagcccgacgtgggacttgatcccaagtctccaggatcaggtcccaggctaaaggcagcaccaaaccactgagcacctgggctgccccaaaaaacaaactcttaattaaatacagagaacaaactggtggttgccagaggggaggcaggtggggggatgggtgaaatagatgaagggaattaagagtgcacttaccttgaggcacctgactcagttggtggagcatgtgactcttgatctctgagtattgagtttgagccccacattgggcatagagattacttgaaataaataaagttgcgactaagttttaaaaaagagtatatttatcttgatgagcgctaaaaatgcatagaatttctgaatcattatatcatacacctgaaactaagaaaacactgtatattaattatacttgaacaaaaaaagaaaaagaaagggggtccctaaacaaagaagtttgagtaagttttaagaaataaagcaatggggatccctgggtggcgcagcagtttagcgcctgcctttggcccagggcgcgatcctggagacctgggatcaaatcccacgtcaggctcccggtgcatggagcctgcttctccctctgcctgtgtctctgcctctctctctctctctctctctctctctgtgcgacgtcaggctcccggtgcatggagcctgcttctcactctgcctgtgtctctgcctctctctctctctctctctctctctctctgggcgactttcttaaataaaaaaaaaaaaaaaaaaaaaaaaaagaaataaagcaatgggtgcctgggtggcttgttcagttaagcatctgactcttgattttggctcaggtcatgatctcagggagtctgcttgtgatcctctcctgctgcccctcccattgctcgttgtctttctctctctctctcaaataaataaataaatcttaaaaaaaaaaaaaaaaaagatagggtgcctgtgtggctcggtctgttgagcttctgccttcagcctgggtcatgatcctggggtcctgggaaggagccccatctccccatctctctgctcagtggggagcccacttttctctctccctctgcctgccactcccttgcttgtgcacatgttctctttctttatctctgtgtcaaatgaataaattgttttaaaaaaaagaaataaagcaaaaacagaatgaggagccttcagactttcttgaaaggatttttgagatatataggagatatactgatatggatcctgtggtaccagagaatttaaaaatgataaatatgacatggcgggggcaaaatatcctagacattcaaaagaaactccaaagtctagagagtaggaatgtctgtgtcacaattggttgagattgcttttaatgttgttttgtttgtttttttagagagggaaggtggggaggcagagggagagaatcccaagcagactctatgctcagcacagagcccagtgtggggcttaatggaggacttaatcccacgacctaagatcatgacctgagctgaaatcaagagtcagatgcccaactgactgagccattcaggtggccctatctttaaagtttttttttttctttaaagtttttaacagacatgtgcaaaagagaaaatagcatagaaaatgaaacagcaggctaccttgctatttgttgccctaattcaaggaaaaccaagaccaggctgaggaccacaatgaggatgaggtgtacccagataagaaatttgaggttcttgggccccacaggatgtctcaatttggggcttcaaggaaggccattggaaaaaggaatgccccaagttcacaaggtctcttaatgggacaggacaacaaactgcccaccagatgcctgaattgactgatagtgaccaagaatgaaggagctcaggggttcctttaaaccctgaaaagcttgtcatcatttcctacaaggaaccccagataacaatgaaggtggaaaatgaagttacagactttttttattgatattggggacacagagtcagtactgaactcctggctctctctgctatcagatcaaaccatggctgtagcaagagtctcagggagaagtgttggctaaaaccttcttacaaccactagcctgacagatggaacaaattcactttaaacacaggtttttgtatatgcctgaatgccccattattttactgggatgtgacctgttaactaaatttaatgctgaagctacttcttctgtacctggtcacctggacaaaaaagtacccccagagcaagcttgtgcctttcaagcaatgttactacatgaaggtggataagtcctatcaaagcttcctgaagaagttatccaaaaggtaagatcactttacacacacacacacacacacacacaagctaagatcagatgtttgggtcaatgggaagctggggcgaacaaagccggtggcactcatgcatgttaaacttcgtggtgggtagagattcagaatctcagtacccaccaaaggaacaaatgaaaaaaagagcattcagcccattctccctgcctttttggaatttggcctcatcggcctgtgatgatctccatacaattcacctatctttcctctacaaaaatcaggcactcaagacttaagagctattcattaaccatattgcagactatatccactgggtgctacccaatctacatactctcttaacaaccttgtctggggactttaggtggttcactgctctggatctaaaggatgctttattttgcatttttcttggtttagatttgtgtgaactgaagaccactgagaccaagagtaagcaacagtattgctggacaatccttccccaaggttttaacaactccctcaccatttttggggaagtcctagctaaagatctgagaaacctctaattagagatggagactctcctccattacgtggatgatatattcattgctgagtaaaacaaaagagtcttcacacttcaatactattttgactctagacattttggctgagggaggttacaaagtttcaaggaaaaaggcccaaatctcacaaaggcccaaatctcccaatgaaatagcacagttttgagttttcaaagagacaaagaaatctgctccctgatagaagggaggctctagtctgagtggtagtccctaccatgcaggagacaattgtgcaagagacaattgtgcagcttgctttctttctttctttctttctttctttctttctttctttctttcttcctttcttctttctttctctcttgattttattttacttattcatgagagacacagagcgagagccaaaggcagaggagaagcaggctccatgcagggagccggatgtgggactggatcccaggtctccgggatcacgccctgggctgcaggcggcgctaaaccgctgcgccactggggctgcccaattgtgcaggtttctatgaatgactgggttttgttgaatttggatacctaactttgtttgacctgctagctaaacccctttatgaagcacttgagtgcctgatttttgtagaggaaaaataggtgaattgtatggagatcaatcacgggctgaatgaggccaaattccaagaaggcggagagaatgggctgaatgctccctttcgcttgttcctttgatgggtactgagattcagaatctctacaccaccataaagtttattttattttattattttttaagatttttatttatttattcatagagacacagagagagagaggcagagacacaggcagagagagaagcaggcccagggtctccaggatcacgccttgggctgcaggcggcgctaaaccactgcgccacgggggctgccctgccataaagtttaatatgcatgagtgtcaccaactttgctcgccccagcttcccattgacccattgagtcttcttgattggactagagaatgtcacaagaccttttggattatcagagaaaagttgttaactgcattgggcctcctggatattaagaattagccttttgatctatctgttcatgaatgacaaggaattattacccttggagtctttttttttttaagatttttaatttatttattcatgagagacagagagagaggcagaggcacaggcagagggagaagcaggctccacgcagggagcccgatgtggcacccagtcccgggaatccaggatcatgacctgggctgaagggaggcactaaaccgctgacccacccaggtgtcccatggccttggagtcttaacccaaaatcttggctgtactagaagatctgatgcttatttctcaaagcaattggacactgttaccaagggatggcctgtctgcttaagagctgccacttgtgatctggtaaaagcagcagaaaattttattttgggccaacccatcactgtctatactccctccactgtgtgcttctcttactaaagcaaaaagaggaatattggttaacatctagaagactggacaaataccaatccactttactagataaccccaatgttactttgaaggctgtcttcactttaaatcctgctaccttgctacttgttagtgcagaagaacccatttatgattgtattcaatagttgagcaagcttattctagctgtctggacctaactgttgtgccattgtaggatcctgacatggaaatgtttactgatggaaacagcttcatgggccaaggacaacagaaaactggatatgcagagattaccagctaaggaactttggaggtggaaactcctccaccagatacctctgttcaaaaggcagaacccattgccgtaacaagggccctttatttggtaagggaaaaaggtaactttatatatagattcaaaatatgctttctcagtgattcatgcacatgggtccatatggaaagaaagagaattattaactataagaaacaaattagacacaccgaagaagttctaaacttatcaactgcagtaatgaaactgagagaattatgcttataatataaccagaactggaagtagttctttgcccaggatataagaagcctaataattatatagctcaaagaaataatcaggctgatcttgtcaccaaggtggcagcccatatgaagtctccaaaaccttctatgatgccgttagtgccagacataggcctaactaaatgccaatccagatattccttggaagacctaagaagagctaaggaatggggatttgggaacaatgctggcacgaaagtcagctagaagggatgcctgggtggctcagcggttaaagtgtctgcctttgactcagggcgtgattctggagtcctaggatcgagccccacatcgggttccctgaggcctgcttgcttctcctctctgtctctctcagaacaaataaataaaatcttaaaaaaaagtcagcagaaatatagtgaataaggagtattccttatcccagaacatcttatggaagaaatagtcatattcaccaaagcaccattatgagtgagatactacttttcagtgggtataagatatattgtgaaccccaaactccagagaattatccaaaagatagtctagaaatgtgacatttgtgctaagaataattctaggattgtgtccccaccagtcctaaaaggtataaaactaggggacacctggctgtctctatcagtaaaacatccaactcttgatcttgaagttgtgagttcaagccttatgttgggtgtagacattactttaaatacatacatacatacatacatacatacatagaactcaaaagcactgaacctggagaggaccagcagatggtcttcaccatgatgcggagaataacagataatttccaatgtttgctagtatttgtagacttttacacgttgggttaagcctttgcatactgttcagagaagttctcacagattgtcaaaaaactttttaaaaatttatttaagaaatttctatacctaatgtgggttttgaactcaagaccctgagattgagtcacatgctctaccaactgagccagccatttgtaattctaattattgaagtgttatgtgtcacagaaataaccagatttctttgtcacctgcattataatgaactctcatcagatctttaaccatggccatttttgagtcttatcatttacggttattgttttaatctgttgctcctgcaaatgtatttcagcttcagagagattcacagaaaggactcggcgaatacaagtttttgatacctttaagatcataaaactaagctgagtaagaatttccagaactaatgggctggatagtgaattcttctggtttcctcaaatacctgactacgactctctaaaactaaaatttttccccattctcttgacttggaatcattgagaaccaaaactgccctttttcctaaagccctgaaaaactgaagctgaacaatttgaagtaaattttagagaaattgccacaatggtcatgtgtagacaatcttagtgcctgttaccgtatgggccactcaagaagatgaccagagacattcaaactgcaaatggggaaaaactatcagattgccactgcctgccctcactccatctgaagatgcttgaagcctgacatctagaaatcttctcactggcagcactcgggactcaaacactggatttataacattaacctgtgtttttgtttccacagaaatatttcttattgcctcttaatataggcctgagaacccacctgcaggaaccacctcctgagatgacccagctgtttaactgaactgacctattctcaagactgagactggttcatgatgtatggagcagactttgtacctacagtccagaatgaatatgagggaacagtgttgatttgtgatgtttttgtaagaaaaaaatcttggtcaaaagagggatcttctcattactcctaaccaatcctgggcttatctagctaggtactgacatttggagaattggaggggtctacacactagggaaatttggttactcctttctctgttcactattccagtgaacttttagaccttttattgagcgaaaagggaatcgacaccagatagggattacttgcctgttatcaagaggctagatcttggtattcttttgggagaacatttttagttggccaacaaagctgctcttaccattgttgcccaacttaaaaagaaagtaaatttgttagctaaggtagcacttgataatcacattgctttgcactatattcttgcagaacaggatagaatgccattgctagcacaactcgctgtgtttatattaacgcttctgctgcagtaaaaactaaaatctcctttagataaaatcagagagcaagccacttggccatagcaaatttcgccagaggtgcctggaaaaagtgactggattactggactctttttctggattccccaagggattagcaatgttacaaggactactcagatttgggttatctatacttttcatttcattaattgtatctgtactaataagatgtgctttccaatgttgctctaaaatggccaaagaagaaactaatgttttggtcatgcagaatgtacatgttaagccgaatactagggaatacttccaacaaagtgcaaaattgtttcattcctcaaaccctaaaactgcaggaagtagccagagcagtcattgtcccaattccttcaagactgaggaatgatcataattctggagggactgaaaatgtgccccataggattaatgaggttaagactaataggaaatttaaagcttgtttttcagaggcctgtctctccctaatcagctattgtttcgtttcagaccccacaacaaatccagtaactgtttccattgaggcttggactgatataaatgaggctcactgacaccaatgccctgcattccttccctgtgataatgagcccaagaacttatgcagtatatacttcctttcagagatgggcatagcccctcttgtcctacagttgacttcctgacatcaggcacccaattgtgcctcgttttaattttgtatctccaccctaaagtgaacatgggatgcgcatgctccatctttcctcatgaatagtcataaatctccctgtcttttgcatcaatgtgtatgtaatcccacccctaagattataaacatttgttctaatttcactcaggggagacagatttgaaccaacctctgtttcctctttttgctgcctttcgaataaatcttttccctgctgcgtacttgatgtttcagtgattggttttgccatgcattgggcagacaaacttgggttcatttacagcattggcaattggttgtgtttaaatcaattttcaattaattaaagttgtaaatttacaaacagattttcttaagtttttaagttgaacttgcataactttgatgttctatttagaaatcttgtaattttcatataaaaataaaagcaataacttgttccttgattaatgttcaattagcccatgggcttgacatattaaatctgcttgaacattactcttgccatttacaaagttagctaattaagttctcttacatatttaaactacatttacaaatttaatatatttgattttttcaagcacttcaaattcctcatatggccaatttatacatcaaacaagaaaatattcaagcatgtaaatgactctcataaacctaatatttcaagcttttaagtgtggcaaatcaagttatcttaaagatttcaatactgtttacaaacataatcaaattatcttatacctttcagcttcaaattacaagtctaaattacacaattcaatttgaaatcacaagactaatctgtcagattctctaatatgccaacttctcttaaatattatacacattaaaaacacgtatacagactatctcaattttcaaaaattttttccttaagggggctcctgggtggctcaatctattgggcgtctgactcttggtttccactcagggtcttgagatcaacccaccctttgggctctgtgctgacctgggagtctacttaaaattctctctcacctccctctgttcctccttgaaactccaactctctatctctctcttaaaaaaaaaatctttttgctaaccttacacaaatgaagtaacattatggacttctttttatatagtcgtttctatttttcttcccaatatggcagaataaaaatgttttctgctcatatttttcttgccacaattctacaatcatcttattgatttgtccctacaactaaagaaaagtctgataattatccttctatttttcttaaaggtttatttattttatatgaaagagagagtgaacatgagtagaaggagagagaatctcatgcaaactctgtgctgagcacataacctgactcagggctcaatctcacaaccctgagatcatgagccgaaccacaagtcagattaaccgactgcaccacccagacgtccttgataattatccttctgagtgtaaacccagatttaaatgaaactaatcaatgtattaatttatattatttatctatgcaaaataataaaaataacacttatgatagagtgaatgatgcaactgaccattatcttataccatcctgttctttctttagtatatgcaaatatatatatatatatatatatatatatatatatatatatatttgcttcatctataaaatgggcatagtaatttctgtcttagtgagagtacagccaaacaagacatctgacataagtacaataactcagcacatgttcatttacttctttctccttttctgtcactacaatctttccccaaaactcagattaaattggagaaattccagagtctctccttcttttaagtgtaaggggcagagggcatatctaggaggcagttttgtgaaacacagaaaaactggctttcttcagagaggcacccccttcctcaccctcatccctccactgcccacagtaggattttgagatgattcactgtgtaaaaaaatagaaataggggtgcctgtctggctcagttgctggagcctatgacccttaatctcagggttatgggttcaaactccaagttgggcatagagattacttaaacaatgtgcatatttgtatcttgtattttaaggatatgttaaggattctaaggtcatgtgaagacaatctgttccattacaatatatattatactatatactatatatcactatacacccaggtggtttgccccatacccttaccaggatagcacttggctttgagcctgcacacaactcttctctcacagagcccagtagcagtattattcaggttttggaaacctcattcttttccagcagccatgggaacccacatctctaagctcaacccagaacatgccttgcactctgattcacaacatccacaattcagagatgctgaacatgtcaaatcctcccgcctttccctggtatggtccacctgagaatttagcaagaaaatgttcccattctggaggaagcctacccatctgccagaaatgaattggagaaattgttctcagaaggccagaggtcaagtgagaaaggggtcagatcaaaacatgacaaggttggtgagcatagcttccatgcagccaatcaccacattagtctgaactttgcaaaaggagtttttcttgtgatgcaatagagcaggcagctttgaagaactgcctttgtgctgtgttcttagccaaagctgggaaaagctgaggcattaagcgccagggatgattccaagattgcaaagcaagagttgaggtaagtggagatgagaaatattctgatttgcctattgatttcaacaatggatgttccctcaaatgttactctccagggcacctgggtggctcagtccgttgggtgtctctcttcggcttgggtcatgatcccagggtcctgggatcgagtcccacattgggctcccagctcagtggagtctgcttctccctctccctcttctcccccccccacccaattgttctctctcactctctcaaataaataagcaaaaaatcttttaaaaaataaaaaataaaaaaataaaaaacaatcttttaaaaaacaaaaaacaaaacaaaaatcaaaaatcaaaaaacaatcaaaaaataaaaaaacccacaaatgttattctctagatgtcacacatgccttcacatcctcataggcatccatttggttaccaaatcccatacttcaggtggagaaagattttatttgaaagagagagacagcaggggtctctctgcctttctctgtgcctctcaacttctcacacctcgtttctggcagtcccggaatgcgctgagatttcagttttggaaacttcatccaggcagaacaaagggcagagtggaggggttcggggtagactcaggccaaacattttggggctcccacaccttcaggatggagttccaactctttccttacaggggcagaggaagccacagcccctgctatggctttagtcccttcagctcttaagtgacttttctcagaaaagttcatttcttctcacattagttcatcacctgatcttggtctgatgaagctgcttatctactggatcattcacacaatttgctgtggatctgctaccggtcatatatgctcagtaggccagatcactgctttttgtttccttattatctgagggcagaacccccaccccggcatttttaatatgccaggggtctggtgtttaccttttttttttttttttttttttttttaaatttttttttttattttttatttatgataggcacacagtgagagagagagagaggggcagagacacaggcagagggagaagcaggctccatgcaccgggagcccgacgtgggattcgatcccgggtctccaggatcacgccctgggccaaaggcaggcgctaaaccgctgcgccacccagggatccctggtgtttacctttttaacatgtctagcaattggtgaacatgccccagaagctgggtttgctagtttcctggttcctttggacgcttccagcaatctttggtaactccattccatctcttcctcttttcctcactgtctgtctctctttgacacacacacacacacacacacacacacaccggattagactgaattaaatccatattttacaagtgtctttgatcaggggcctttacatctgaggtatgtacaactggagtaggatatggtgatggcttcttttaattagtgaatgaattaattttattttaatgctactcaattgggtcataaaaacttactttcaattcactgagtggtttgggcaaaggaagaattttcttgtttggatggacacaaaaggaggaggtaaaacagcagacacgtgaaggtaaactgtgggggtggggtggggaggcagggagacaagggaggctctgggtacaaggtaaggcaggctttatacccacactgcacagctgagcagatgacacctggacacgcctctctcctggggctgtactgtccccgtgcagtgcccccacagacaggaatctagacctctttgatggaaagaagctacaatttcagaagaaccagaattttgagactttaacttccttaaaacccgcagaatccatctgctcccctgcacccgcaggacctctgcctttctctgtgcctcccaacttctcacgtctcgcttccggcagccccggaatgcgctgagatttcggttttggaaacttcatccaggcagggcaaagggcggagtggtgggggtccgggtagactcaggccaaacattttggggctccccacgccttcaggaggaagttccaactcttcccttacagggacagagaaagccacagcccctgccgctgcccgcccgccttccttctagcgctagaaacgccctcaagcggttctcaaaaccccgcggggccggcggggcaggtgcacctgaggccccgcccaccagagggcacgctggcgtgcttggggcggcagcggccatcttggatcctggcagcccgcccaccttcgcggtctccgccttcctggggcggtggcgccgcggctgcgagcgggtgcacggagaggcgagtcgccacccggcctctcttgaggcttggcggtcttgtgctggagaccgacggcctcgtccccacctggccggcctctacgtaaaacttcgagccagtatcgagggggcaagtgccggctcctgccccttctacctggtgactctgggcaggtacctcagtttcctttatctgtaaagttggagtttaagcctcagcctcacctcccaacccctcaggtcactgattctaatacttactgattgggcgtgtatgataaattctcagcacatggcctggcatggagtgtgttccctgtaggtcgtctaggagcttttcctgcagattgcagggtgccttgtagccaccactgttggggggggatctccacgagggaagtgtgtagtggactttggtaagacccgagtccaaagggagaggggactgcaagatgccctcaagcagtgaaggtgaagcccctaagccctttaggacttgcatgtgaccattttggaagggtgtcagaaacacagaccgggatgcccaggactggaaagacttagtaggaacatttgaacgcccccgtgcttgttatttttatcacccctcgttgccttcccatagggactgggatgcagcacaaaattcctggaacaaaaagccctgtgtgtgtgtgtgtgtgtgtttacgtgtgctagttgtgggggacatggggaataggggactgagacactgtgtcccagggagagccaggtgtgagggagaagggtctattgggccaggatggatagtggccccggggagcggcattaaaatcaggcctggcggaggcctctaggagtccccagacatgcaactgccctaccaggtccacagacagagcccagcaccctaatttcctaaggggtgggaaacttgcctgggacacaagagatgagggaggtgcctggggagggaccaaggccttgtagggagctagggcctgggagaatcatacccagccttctacaggtttgtggaggcctaataatgagctctaattcagtaataacccgggtgaatgccaggcatgcctgggttctcctagtccagcctggtggagtgaggggtagcaggggatacagaaattagcatatggaatcaggggattacagtttattttcagacacactcagagggtgggggctggtcagcgggctccatctgcatccgctccctgcatttggcttaatcatgaacttctctctcctttcccccagacctgtaggctgtgcaagatagacaaggtatttccacccccactcacagaaggggcttaggcaggtgaggagtgtgaaaagtggggggttggggggtcgagttcaagtattcagtttttccatccacacccccagattacactgtgcccaggccacaagggaggatcccaaccctggggttcctagggacattaacagcccttttctcactcagaaacctccagatgagctccttaccctctttccctgacaatagcaaaccagttctaaactctacagtctgggcaagaaggggacctcagcactccacttatccaagacccctccttccttgtttgaagtgatagggccagggtgggcttcacttgtagtgaataggtcgggtttaaatggtaataggtgagaggaaggaagaacactgaggatctcaggaggcagacttagggggtgctgatgaagttgtgacagctctggtctgcacccccatgccatcctcatcccacccagacccagaatccctgagagtctgctgcaaaggcagtatgaggtgggggcagtgggagagcaggggggagagcttaggaagtgccaggactgggctccaggcccagtagtcatgctctggccttctagaacagctgagtcctacggaatatagagtggcctactaaccccccacacctcagacatcctggcttagacagagtggtgggtatggtggggagggtccttccaagggcattataaaaaagctataactgttaaaaatttgggggaaagtgactctcagcctcttgcttccccaagttgtcagtctccccagtacccaaagatagggtggagagagccccagagagctgaggaagaaggatacagcctgtctctgacaggatggggcccagagaggggacccattagcaccatgcaatgttggggcacccctggcagcctgactgaccctgggcagggaccctctcaaactggagtgcacacttgctaaagcttctgtaatcttgaggagggcccctgctggggagggggtgagggagaaggcttggctgaagtccaggcagaggtgtcagctaggacccaaagggcccctctgggagtcatgatttgaagaatcttcgtaccacaaactggcccaacagaaccacagacagcactatcagcacgttcaggatggggccgtttcccaagttcagggctgccacctgccaggagagacagagtggtcacagtggggctgacagaaaatataggcactccagggctggggcagagctgggagagagaggtgtcccagtagcagggaggaggtagccagtgcttgggcacctacccagccacccctctgcgcgatccaccgggcaatgcaatgatgcagcatgaagtcggccacgaagcgggtcacctggcccaggaagccggtcaggccgcgttggtagacatgcagggccaggcggtagccaaagcccaggagagccaccactcggccccagttgatgccgctctcaaataggctgcagacagaatggtgatactgtcagtggagacccccggagggcccgtggcctgctcttcctctcccaccatctggtacccacccgccctgctcccagctggaaagcaaaatggcttagctgtaatcagggtggcagaggctgccccagcctggcctgagtttgggaagagcctgcatctctgtgaaaggagaaaaactcagagggcagaggagcagggcgctgctgctggattgtggccccagtgccgtggggagcatagaggggcagagagcagggagggcagagcaagcagacggaggcagcggggagattacctgtgggtgttgctgctggcctggcagcccgagagacagcagagagagaaggacaaagaggaagttaggataggtcctggaatccgagaggggcaggtgtggcttcgaaggacggggcatgatgttccagctctgagcactaaccctaaatctattgcctacccctaccttcaccgcagcgtcagtcaccttgaggctgactcctaacccagatctcacaatagatgacaccagtaagtacagccactgttctaagcctacttcctctattttatagacacggtgtctgagggccagagggtttcacaaagcccgtaagtggcaaagccgagatttgacccaggcatgtggtcaactacagcagactgcctctcagacaccagatggtagtaaaggggaagtcatttccaggacacaagcagcctgtctttggtagggaatatgattccaaactggaaggatagctgtgtctcggcgaggctgggaagctctggggacatcctgatcctgggcacctctcgagtcctgatctatcccgtcaagtcctcggtgcctcagctcacagaagctgtgagcttatacactgaagatgacgagtctgggcccagagagagagagagacaggggcccaacaccatgcgtgagctaacagcaggtacgggaatggcacaggtgtctcttgacactgacagagaagcgtgtctcttccaacccatgggcaggacaccgtgtgaaggcgacagcacagtagagaggccagggctggggctacctcgaggcaatcttggtgaagtactcataggcattctctgctgtcggctgtaggtgctgcagcatggcctggaactccgagtcatagcgctggttgatgtcgtccccaatgatagcgagctgccgacccacctgccccatggtgctggaggaatgggagccaggtaggtgagcacagggcaggcaaggctggggcctgggctcacggagaaggggttccacctaagatgcctccggcctcgtggacccctccttggagattcctaaccgtgttctcaggcccagcctggggtcatggggcacacatgctgccatgaagggcgcaaggtcccacatggaggtggaagcccaaatgaaaaaggcaatgatggcagaaggacaggaacccccggacccccacccaaggcctccccagctccccgacctgcagggcattgaccccatacgagcctccatctccccgaagatgtcccagagggcccggggggctgttgctcacctgctaggttctaggggcaaggtgaccatttctgggtcagctggcacagccgccccctcagcctcctgctcctgccgatggcggtaaaaaacatagctgcggaaaacctcctcggtgtcccgggctacctgctcctctaaggatcaaagccaggagtcagggaggaagggctggaccaggcagccccgtgctctgtggatgggtcacccttcctgaaggccccagccggcctctcctgtgtcttccacggaggacagtgctagctgctccagcccttcgttaacagctagcgatttctgtttgggatgagcctcccaacagccttgcaaagtaggtgagcaccagtgtacagatggggaagatgaggcctgcggtgttacatacctgcacgaggtcacacagagcgagccacggagtaaccagggcctaacccaggcatgtgggatttttagtgtgagcttagtgtgcaatggtacctggccctatggctcagagagtatggaaggcgaaatttgaaattgtagcttttgggcccagaaaagtcacgcagggacatagtgaccgagcggagccctgagcccgacacccagagagcagtctgtagtggtctggggatggcaggcttccctgatggtccccttggaagagggaagaagggcagccattgtacttcctccccaaagtcgtaacactaacaattgctttcgccagttagcacgcctgacagggtgataagcctaggaacttccttctttctcttactgtaggaataggagagccacaccccactcttctcacctctcctcacccctccctgctcctttttccttaggatggtgctgtgtcccacctcacactcactctgggggctctcctagcccctgcccccccacgccccaccctgcccccaggcccagactcttccccactcccagggattaacctggactgtactccagcttctgaggccacccacacccacctgcactgggtggggagatgcttttctcctttatcccaggtgagtgaatagagggcaggagagcctgcctataagtcctgcctggccctgtccacttctgctctcaccatcctctccgacagccctggtggttatgggatgggtgaggggcagagagacccttaccagaagtagaagacggggcagcctctccacactcccgcctgggaggccctgggccttgcccggatgccatttctcaggtcccagtggaggactgggtcagcctgtggggatgggtgagaaaaagcagagatggagacgggctggggctgttgcaagacattcccacagccccacagccacagagaaaggaggaggggcccccactcctagaagaccccatggccctagctgtagccgcctctcatttcaccaccttgggtccctgtggagtctgctggcagaatcagaacttcctgagcatttcactagcagtccttcaagagagggagaaaggcagggcagtcaggactcacatctagggacccggagcctgcagccaggaccctggggaggggtgagagcagcagtgcccttgtggctctcaagtcataattcacctcactcctgggcaaatgaggggagttttagaggccgagggttctttctgttgctcctggggcctcttgcaccctacctagcacatgcttaccacaggattgccaccttctagccaatgacccatgaaggctgtgcttgaagggcccacttccccttggccagccagagcatgcctgatttccaactcaggcctgttagccacgaacatttcctgagcaccttcgccttacttacttctcccactcctccaggggtgccagacactgaaaatgtacatccactcagcaaggtaagcatcagcagacccattctacagggggtgaagtgagggaccaagaagttagggaggggcccaagggagtcaggtcggtaatgggaacctccaggagctcataccttcaattctaacttaagattgattttccagtttgtgggcctcagggggtaccctttcaaggcgaggagacctgtgtacagcccaccggtgctctccccattcctgcctgcagtgagctaaggaagccttctctgcggctgccccccgcccaccccacaggtcacctaccacatacctgctcctgctctcctgtccccagccccgttttcctctttgctcagtgctggccacagccctgatctgctctgtgaaccctcggccaagggagtgtttcctggacgtgagctgtttcactttcaatttgcaccccttcatagccaactccccccccccccccaggctgcctctgtcagccttttggggaagtgctcctcctcccacccctggggaaggtgtagtccaaccctgggccaagcactgccacctcctcctcccctcttggaggacctgagagcaccctccccgcctacctcctgcctctcaggcctggggccatttttgaaagtgccccaaggcaggggttctcaggaaggggtgtggagggctctccgccccagcatttactgggggcaggggtagggagaaggtagggcctcccctcctccagccctgggagccagtgcagattgcttggcacacccccacccctgctgctccttccggaacaggatgcccttccctctcccctgtccccaaacaaaagtggcaccccgaggacaccccggcaggaggatgctgactgcacaaccaactccaactgcccctagcccagggtctcactgctgggaagtaggaggggtgtcagagcagcccccagggccagaggcctgtgccatcctgccctcatccaaaggcctgacttcctggtaaggggagtccagtgctctccacttgctaggcctagatgttccctagggggagatgcctgcttgggaggctcctggggcagaaagaagcatcatgtgagttctctccctgcccttgaccttggctctgacctctgattcccaactccacctccagcccccactgcaaaaggacccggttctttggtgcccagagccagggcaggttcgggggtgggcaggtgggggggcaaactgtctgaggggcagccagagggagccctgcctggatcggccccagcaggggttggctgcccaggcaagcctccagacctaccctcccccccaccccccccatccccaccccaacctggctgcctgcagactcctgggtctggggctgctgaacgctgcgaggatgggcaagaccctcctaccttacctgcccgactctagcccaggcctgggatggctcacagggccgaggccaaagatcctgagaggccagcagctgttccccgggggctgggtgcccaggcccagcttccaggaacaggcgtcaggagagtcctggagtctggacgcagcctcagcctgtcacggcgtggccctagtgctgcggtgatcctagaggtgccggctgctccggctccgatcagctccccctagaggaagctgctgtgtggccgccggatgcggatgctgagcccgtggcttgggggtcggtctaggctctcacgtgggggaggcgctccaccccccacacttggccccggtcaggcagtgtggcttcccctctcccactcctgatgcccagtcccggcctttgatcttcaccccctttcatcaaacagtaccaataaaaaagccaggatggcagagtttcttaagcaccacagtgtgccttgcactttagcgagggacacttatccctctgaatcttttcagtaacccctggaagtaggttctgtccactacacctgttttacagatgaacaaactgagactcagcgggtttaaggaactccctaggtcactaagctggatttataatcaagtctgtggatgccgtggggaataataccactaaattgagattccacgtgcaattgagatgtgtacccaaggcaccttggtggtctccagagattcaaaatcctgaaggtgacagacaggtagacagagatgaaaacaggggtgtctgggtaccacctgggcacgtgccagtggatgctgcaaggagagaagagaggaaggacagatagctgtagggactggttctcaagggcaggggcagccccgaccagggaaggacaagccaggtagagaggggtgtgtacagaggccccaagagcccctgcccccttctccgtccaggtacctccagcttcctctaccggcccccccaccccccatgcctcctggagcctaccccaaatccactgcctcatacctccttcccctgcctcatgactcttccctctctgcccccagctaatcccccctaccatgtcttcctcccagcctccccatcccccccaccctccatctgacctttgccttctagaactcctggaagtttccaactggaggttttaatttggaaactcctcctgttcttaagcagttggtggaggtggctgctacggcccctcccttggagtcagggtccctcaggatggagaccccagcttcaacccctcaatcccgaattttgggccgctcctccatgttccgctttttccgtagcctggtggggagcaagggcagcctaaagagctctgacaagggcctgatggggagtcaggcatgcccctcacaagagcaagatgccacccccctgatgataaactgccagggaggggtggggaggaaggagctgaggccgcccaccacactgtcctacacgctctctgtggctttgccacagcacaattccttggggctagggatgggggacacaggggcccagatccccactcccatggaggtcctgagagtgggggcccagggtagagaggtgaaacccatcctgtccaggggaagccagaagatgctgggcagcccatcggagaagaaggaaagggaaaagaaagagaaggcagtaggggaggcctccggagatacaaggacctcagacaagtgagggactgggctatggggggcaggtaggggccttggatggggggactggggcaagatatggggctgagatgggaggacccatattgaggagggtccaggaatataggtcttcagatggatagaggactggagtaaggccctcacctgggtgcggaagggacagatatatcgaggataggagggaacctgaggggcttggggaccagagatggggtgagtcttcccacaagtcagaggttgtgggtggaggcaccaaagatgagagaaggacaggctggggatcgggaggggcaagtgcaagggtgagccaggctgccatggcttcccagctccttcctggtccccactctaccctaccttccctccccattctctccctcctggtccccactcccatggggacctggcatcactccctgtgaggaagagggcccacctcctcttctgttccccaccttccttctcactctgccttcaaggagggatacccccctgtatggtgaagaccctagagggccaagcagggatctgttggaggtgggaggggggaggggcctgagcagggcccatgggagggccttagggagtttggggggtttaaggaagcctttgtcacatctctggctccacctgccacccccatctgactctgctttggggtcaggggccactttgtccaagcattggaggtggaacagcatccccacagagggctgtggggccactggaggtctgccccaagaccttcaccagggaggagaaggagtgtctgcttgacggtgagtgtggtggccataggcattgagacagtgccagaaataggcccttgtcctaagactcgttaggggtgtggggcctggaatggaaggacaagggataggtatgagggaaggaggggagggagggggcaggctgcctggatttgaatcccttctggtgcactatgccaagctgtgggatgggggcaaagttgctcaaccattctgtgcctcagtttccttacctacagaatgagaatggagcagtatctacctcagggggcaggtgcaaggagtcagtgagatgctctttggaaagtgcttagtgctatgcctggcacataggagttgtttgctaacaaaacgaggcacctcaccctcacttgagcctgcttggtgtgtccccatcctgctgggcccaactaggcctgggcttacccctcgttcctgtcagcctgtcagttacactgctccttcacaggagacctcaggctggcctcttcgaaggtcggggcaactccttggaactgactcctcaccttgtacaagcagcttcagaaatcagccatggccaaaggtctgtgggactaggctggggcaatagagggggtgaagcctgggtcggggccccaacccacatgttgtgaggccccgggatttgtggcttgcgcagacccctctcagcccttggggagctgttccctcctgccttttgttttatctgggggtgggggcggggctgcaggcttgggttcttttcctcctcacctgttcagcaaccgggcataccctcagtttcttctcaaggaaagcttgtctgatgaggagaaaggcaaggaagaggaaatggaggaagatgacagctccttcaagctctgtgtcccaggcattgtccccctgcagtcaccgctgcataagactttcagatcaacaaatacagtggggaagtgcagcgtgcaacccgccctcaggcccagagggctcccctttgactgaggctcatgggtgtgataccagttcttaccaccaggtgggaccagaggacctaagatgactactggagccgggttggcggggcctgagtcctgcttagtctggctagagtcctttctcagcatttgggaggcagtgaggtggggactgtgactggggcttgcgctccaggagcatcaccctttctgagcccagaattctaacttgtttggtgccccttgctgcccagacacagtgagcaaggatgggaatagcttaacatgatagcataacgtgatcattgctgtcatttacatagccattattactatgggccagaccctcttctgaacacttttcatgaaataccatatcacaaccccaaggtaggtcccattataatatctacttcatagtgaggaagcagaggcacagataggttaagtaacttgtccaaggtcacacagctagtaagtggcagagctgggatttgaaccaggggagtttgggtagttccagatccttgttcttgagtctatggctggtggaaagtgggggcaggtgtttgtccctggcatgctctccccaggaggtgaggaaactcacactcatgcatgtaggagggagcccacggccagtgagcttccagggggatgtcagggagatggggaggagctgtgtggctggctccaggtaatggagatgtaggggctggggttggagatgaccagggactgcacagggctgggatgaggtctggagagtcggagccgccttttcttccatccccagcaggtttctccaccctctcctgcctgtcccatgcccatctctctgattctcaggtttcgtggagtcggagttaaagaagcttctgatagttcaacgggagtctggtctctggaagatgggcagccatgagggccaagagctgctgacccagccagagatcaccctggaggaggcgggcattgtggatggccaggtacttctggcctgtcccaaccaccacccctctgcctgaggccattggagaaagtagggcctcctacctccataggcccctggccctggcctcaacctcccagggcctggatagggaaggcatgattccctcttggtagtatttctgagagtaggggcttgacccccggtgcacacacacttgcccagcagtctctccatctcttacttgaccccataatgttgctcttttcctgttttctctcccaatcccccatgcttcctcccataaaggctcatcggttacccatctgtgtcgcaccatggcccactcactgcccaccctccttgacatcagccttcaaggtcaggcctgtcccagcttctctgagcacatacaggtggatctgttatggaaagaagtgttgatgtgctttttgaattaattttcattcattcaacaactcattctttcattctgtggacatttggcccagatagcctctatagtttccttttgtagaaaaatgaaggaaagagtgtagggttcagaggccaaaggctttagttgaagccttgttttggcatggattttctctgtgctttggatgcgggctgtggcatctttacttgtaaagggagactggtgggaggatcagatggcacttgatcttagccaaatgaccgagaagtgagtgaaggatcaaacatgatgaagagggggtgcctggcagtgccaagggcactctggtgttagggatgtgactttcccctttcggggagtgaataccaggaatgcctgtccccatcccctgggcactgaggggcagccttctcattgtcctgagtcacaatgttcccttgtgctctagggaactaggctgtgcaccccatcctagactacagagggtggtcagctctggcagggccctttgctttgccttttcacgctaaagggatctctagtcacccttcctgccctcttctcacccctatcctctccagaaccatccttgagtcagtctgcccctgtcccaggggtacggatcacggtcctggggtagcctgagcagtattgggggcccgtagggagtttccgggttgtggcaggtcggggcccagcccagtcctcacttgggggacagagctacctcaggaatgtcttccttctatgggtatttcaagggtcctgtcctcatcaccactccctactctctctttatctgccctcaaggacaccaagctgagggggaaggaagccacccaccagcctttggggaaatgctggggacctgggggggggggtgctgaggcagctgaaacaccactctaggctggagggaagggtgcagagtccccgtggtgtggcatccaggacagaggtgagggaagggagggcttggctggggtgcctgactcctggggctccaaggaccacctcccccatcaagttggagggaggaggatccctcatttagtgggagggaggtggactgggctggctgtggggagatgggggagggtctggcatggcctcagggtgcttatctctgggggtacagagcaggaagggtgagcccaccgagctgatgcctctttcttcatccatttctaaccctagcacttgctcctggaggagatggacgagatgggaaactggcccccatagtgaagctggtgttggcccgagtttgcttgctcccaggtcccttcagccccagtagaagtttagcctctctcatgagggcacacccgaggcgcccctggggccaaggggtcttaagatcaatggtattcatgcatctgcagggtgggctgcccagcagtgtctccacccaccagactcaggcctgtgctattattaataaaaccctctttgactttggcctccttggctatctctggagctcactcctcatcctcaggctaggtgccagctcagtttacccaggatctcagtctagccctcagtgtggcagccctaaccacagagccctgggttctagcggaggggctgcagtggggcatctaagctgcagggtcagaggcttggtgtacctgcctgggtggtccagaatgccagggaagcccctgtgaccacagggccagaccctgtgagtgggagcatccctgacttccctccctccaaagttcccaagccaggcaggcggcctcacggggaagatccgggaattctgcagcaggaagttcctgcccagctaccacagggacaaagccaggaaagcagccttggggtcatggggagctgcttggagactgggctgggggcaggtaaggggtccccgggagtgacacaggagggccgctgctataggggtgggggccaggccccatcctgctgcccctggttacagcccctctatgccatgctcagtgctaggtgcctcaggggatcttggccagagggaggtccagacatttagaagacccaaatcttcatccaggaagcaaggataggcttgagttgggggaaatgctgtgcccttagtggccatggaagggtgcaccttcatacctggcttttcagggatgcagtgggagggagggccaggcccagtttggacaccagaaggtgttgtttgcctggaatccttgactcaggctctgggctaggggctggtggaagggcccttctgactgtatgtcccctgagtcagccaggaagcagcctcgtgacaatatgactcacctgtgccctaattattttgtcccagagtgctggctgttgggaagggtgggggccttagacagtggcctgtgggggttcctggttccacctgggccctttgatcaccctcagcacagatggagcactcctcatggaccctgtctgtgccctacctccatcctcataggcccctgaccttgtgccaggccatgcccaggcttggatggggaatccagggcccagagcactgcaggacagaacgtctgctcccccgttgccctctgggtgggaccagccagtggagtgcacagacagccctacgttgggttggggtaggctaggtccccactggcagctcaggctccttggctgcccgtgtgagccacgtcgtcactcataggtcacctctgctcctagggaaggagcatctcatcctcagccctacaggagtgtggctgctggggaggcagggggcaggaaccttgatttagtatcagagactctgaagtgatcactcccctctctgcttctccctttccctttctctcagtgagggtcatgccacctcctgcccccctacctccggagggttcccatgaactacagagaaggtctctgaggctgggaggtatcctgtggaagcaggaagagggtctgcgcactgatgcaggcacaagggcctcatctcggccccttgaagtccttggctggcttgtgtgggtgggatgacactcatgagtgatgaaggcaggggtaacatgacctggggacctgctgtgggggaaggcccagtgggcaagtgcggagggctggactcaggctcacggccacagggagagaaccgggcatttcccagaggcttccagggacttctgtagctgcatctgtgggtcagatctgtggactgggtggcactgaaagtggccctcctcccccgcaggcacacagcagggcagggctgggtcaaaggccagagggctctggaacccagccagggtgcctctctctgattcactccagagcaccagttgggttgacagtggccctgggccagcctgtgggtttgaggggagccgttatttcggaactcacccggtctcggctcctttttgggtttcgtcttccctctgttgtctttgcatgtgtggctctgtttcgtgctctttccacatacacacccctcatacttctctttctgtgtttctatctctttcttactgtatctctggtgggatagaggtaagaaaagcagcctgcgattattctgagggcatttttgaaacccggaggtggctgaaaggaaggtagaggggagtgatgggggggtggggagacacagatggtcccagggaaaagtggccaaagctgggcctgcctggagagccggtgaatctctctccctgcgggctcctgggcaggacctctgtggaagatgctgccttgggccatatctagagtcactgttggtcaatcttgcctgtgcccgagcaagggaatggcaaaaccacctgtattcttttccaggtgggtggtgaaatggagaacagagaggcagagggaagagactcactgggttggagccccagctgcaaggctggcaagctcatgtgatcgcatacaggacccatacctctcagagtctcactttccacatccatgacatgggcaattcatggggcttctcgggttggctattcggcgtagaacaaatatttatcaagcacctactatatccccctcctattctaggcactagggaatagagcagagaagatgtacagaacctttattattttctttgaggatttatcatattgctagaaggatagacaacaaaatacatcagggagtgataagtactatgaagaaagatgagctgggtaatgggatgctgttttagatcaatggggtgggaaaggcagctctaaggagattatgtgttagcaggaacctggaggaaggggggggggtgttgggggaagggcattacagcagagggaatagcaagtgcaggtgccctgaggcaggagcaggctccagtgtgtttgaagaaggggaagaaggagggtggggggtggggacagggagtgagggagagggaataataggtgaggtctggagggaagggagaggacatgtatttagcccatctgagttttttctggggattatttgaacacagcgaggagtgacctgatgtggtttatggtttcagagtcctccttggctgctgagggggaatgagactatagaggcagggactgcagcctgcagcagggaggctgctggagtcgtgaggcaggtggcctcactgctgtaattattacaggggtactgactgggggctgctgtgggggggatctcccaccagggagcgccccctggcccgcacctctgtgcagcagtcagccaggggctcccccagggcaacctcccagccccgcccctgagggcagagaggggcaccctgggcttggagcgggagaaggcccaggaaggctagtggtaggccccagtcgtgtgtgggccactgcagtgcgagggcagcactgaggtgcgaggtgccgcaaatgcagcctggccccctgcccccacccccaggcccctcgcaggggcagagcccagaggcggtctgacttaattcatggggagaggaggataagatacctccctgctcacaggaaattcacagtcgggggagtggggtaacagcagactcctgcaatgaaagcagatgatgaggttcggacagtatgctggagggagccagtcatatcagcagggaggaatccagaaggcttcaaggaggaggcaccatttgtgatttggactagcagggggagggagaattcgatggatgaaatggggggggggggagggcatgcctgccaggagaacgctgtcctgatgggaaagtgtccagtgggcaccacatccctctgtccacctccgtgagccatcccagacgtctctcctgggcctcctgttctgtccacctgttcatatgtcatcctttgctccctgccatcagtccctcttcacacgtgctctctccaggcctttcctggagccccaaatcacagccacagcttcctgggcctctctaagctgctgccccaccatgcccaggtcctccctgcccctcctcaataagccctgcccatgtcatacagctcagctccagcacctcttctcctggagcactcaaatctccctggctctgcatgagcaggagctgtcagctcacctgctcttccctaccctggacagatactctgtgaggacaggatgggtcctggggggcctgggctcccgtcggcagtgtctacagtgtccactgtagtggttggcacacaatagactcaacacatgctgctagactgaggggggaagggaggggaggggctcaaggctattgctggaaagataggcaggggccagattgtataggaccactaataccatcctaaatggcttggtaagatgtactgtggagggtggaggggacaggattggccaatttggaggctctcaagtgtcctagtgagaagggtgtgggcctgagctgggacaggggcagatggggtggacaggaggacacttaggtagtcattctcaaccagggacattctttctgctaggagccatttggcactgtctggagacatttttggtttgtgacaagttaggggagggtgctactaacatctagtgtgtagagacctctctagctcagtttcctcagctttaataaaagtcattaggaggattaaacaggttaatacatgtttggtgtttagaaaagtggctgatacatacaatacactatgtaacatgagctactgttattttaaaacataaatcctctgttcagagctccacactggttccccatcagtaagtgtgagccaaagtccttccaagggtgataaggcccctctttatctagttgctgctccgtctctgaccccctctcctgctgccctccttgctctgtgtgctctggcctcaccagcttctttgctgttccttgcaaacactctcccccctgccccccccacacactcctgcttcagggcctttgcacttgctgttccctctgctttggaggctctgcctttaggaatttatgtgattcatttccttgcctccttaaggtctttggctgtcaccttctcaggagggcttcttatccactgtatatgttgtgggggggcgggggggaggcatttattccctttcattccctgaaactggctctgtccttgtgctcctgccttgcttttcttccaagcactttaatcatctaatgtagcacctatttcatttgtgtgtatgtgtgcttattgtctctcaactggaacgtaagcttcataagggcagacattgttgcctgttttgcttgctgctgtgtccacagggcctcgaactttactagcacattctaagtgttccttaaatattgcttaagtgaatgaatggagtgagtgagcgagggaaaaactccatcaggagtcagagaggtaggagacgaatggaaagaagaaagaatggtgcaggggaagggagaggccaagttgacctctgaaagggagaggcctgaggcatggagccttgctcatttgctctccccaaggccttccatccctgcttacagggatcttcctgcctctgccagccaggccctgagtagggcacccgcagcccaggcagatggccaggcctgaacaaagtgtccttttccctctgataagcggcctctttccaggggcatgcagggcaggatgtgtcctgctgctcaggaagtgcctgagggtctgggtgggcctctggagtgggcatgaggcctagggctgtagtcatcctgcctggaggctgagcagagagggtggggccgcggggggctgaccccagcccgccaccaactcctgcagacacccactcctccttcactcagcaactctattgagagcctgttggaaatatggctgtgcaagtccctgccttggaggggatgagggagactgggtgacaggttgccacaccctgggacattggcctgccttggctgctttgccttgggctcctgtggtatgaggttggactggaggcctagatcagctccagggacagcggggacaggtggggtactggagaggtggctcccttcttgacctcagggcaaggagtgaagaccatgcatttctccaggcctgcctgagcccccaggtcttccactcccaatctgcaaatgtttccctgtgctcccaggaaactgtcagtggtttctgatgattagctgttgctagcttcttgggaaccctgagccccaagaccccaggaccagagcgctagctcctccaaccctcatggacctttttctggctcagcacactcttgactcagccccttcctcttgaacccctctcatccttttggtcctgcctcagcttctccactgcgctggaaagtctgtgccctacaagaggggagtttggccatggcacagtatcttctagtgagtggagtaaccctcccctgttcaggcacacatgccagtgcttgtacaaagcaggcacagacttaaataccccttgggcatatgcatccccccacatacctctcccagttgccgaccccccctgggcgtagggcctgaggactccttggccttcgttgtcatggacaggcaggatggggcagaggcaggtagtgacagccaagctctgcactctgggagccccagtcttcagatctgtaggataggggctgacttaaggcctcttggtaactctcaggcctctaacctgtgaggtccctgttagcgcagggagagacccattctgcaatgttacctgtggtagtttagaagcatggtcccagtatcctttggcactctttccagggaagggtgggatctatgtccttcttcccttgaatctgtgagggttgtggctgcttccatcagtaaaatacaatggaggtgatgccatgtgactctggaaatgaagttatagggatgcgtgggtggctcagcggttaagcatctgccttcggctcagggtgtgaccctggggtcccaggatcgagtcccatattgagcctgcttctccctctgcctgtgtctctgcctttctctctctctctctctttctctctctgtgtgtgtgtctctcatgaataagtaaaatctttaaaaataataataaaataaaaactattttaagggatccctgggtggcgcagcggtttggcgcctgcctttggcccagggcacgatcctggatacctgggatcgaatcccacgtcgggctcccagtgcatggagcctgcttctccctctgcctatgtctctgcctctctctctctctctctctatcataaataaataaaaattaaaaaaaaaactattttaaaaaaaggccacgtaggttcctcttgcttcacttatattattatataaatttaattaatttaagatagtcacagagagagagagaggcagagacacaggcagagggagaagcaggctccatgcaccgggagcctgatgtgggattcgatcccgggtctccaggatcacgccctgggccaaaggcaggcaccaaaccgctgcgccacccagggatccctcctcttgcttctcttagggtcttggtttcctcacctttcaggtgggcggaacagcagcagtgccctgccacagggccatttgaagaatcagtgcatcgatagagacatggaaggactatggtaaggttcagaaaatgctcattcttattggctccgaatgagagcagtgtgagctgctaggtgtgtcctggctggaggtctgaacaggttctggagtcagcctgccagctgccactcccagcactcaagcccttaggggagcgagctggagaagccaaaggaagctaattagtttggaacccttgaatctggatttttactcgggcagcctggcataggcctcttttaaagaactccacaacctctgtcatcccatccccggcaccttccattacccacaacctggaagtcatccctgctgtctaatttcttttccccctgctgtgcgttttgtctgttgggacaaagggagagctaatgaatcatggtggttggtgctggagtctgcaggaatcagagcaggtgcagcctccatgtgtcccgcagactgtggtacccagacagaagccatcctgggcatggaggcccacttggctcagaatggagggagccaggccaggcccactggaagttggagtcggaggaaagatttagaaggaggctggagccataggccttggtagagtccctgtcccaatggtaagggtctcctcccagccaccgccgagttctaggtagggactgtgaaggcaaaggaactgccctctcgtgggcgtaactcgtgggtgagcacattcccctcctgtctgcaacccttctgcagagggtagattaagccggcaggctctgcgggtcaggcaggcctgagtttgggtcctagctctgtcacttattagcggtgtggcactgaacaagccccttcacttccctgagctttccttatctgcagcatagggacaccttactagtggacagccctcaccaacctgttagatagatgagtttccactccctcggtagcgtggggatgatccattagctgtttgattgccttcaagtctgctcagctctgtgagcctcaattttctcatctgtaaaatggggcagggatgaggctagcctaagggcagtaatgcagccatagcaccacctaggggcagtggtcagcaatagtttctgtttctgactcctgctccaagagcttggagagagcgccttcctctcagttcgcccagtcaattctagagggctggctgaggtgctgggggccgctcctgggtgtgcctatgttcagaaagagggcagtgctgactaaagagggaactgctgaggcccagcttggcccaagacctgctgctcagaggtctgctctgggtcaggtgccgggcaggagctgggtgccatggcgactgagatgcttaggtccttggggagctgtcaccctgctgcccctgcagagtggccagcaacacagcacgggactcagtaggtatctgtcaaacggctggacgcagcactcctcaccagactgccctgaaggtctgaggctgggcctgttcatggcagaccaggaggtcttccaaagaaaagcctggccagcttcaatggcccagacccagagggctctgcagcactggggccccaggaaggtagcaccttgctcaacagctcagggttcttctgtgcaccctgggactgttctcgtgttggggtgggattgggggctgggcttcgcccggcctctgtgaggctcctctcttggtcttgggctggagaggaagagagccccaggagctccgtgggggtgtgggaggaagaggctgattgctcagcccaggagtccctcctctcccgcccgctgctctccatctggccggcagcctcccccgctgccccaggacaagggccctagtgtctgcttggctcctgggcaaacagcaggcctttctctccttctcccctacagagtgcctcagctgtgacccttccctgccccctcagaagggcatggctcaccccttgctgcaggacctcttccatattatccagaaacagaggctggaataggagcagatcctgtttggtgggcgaacccctagatttcagccattcccagcttcggccaaggagcccaggcaaggaagggccggatcacagggctccagccctgccaaggtgggtgtggggcgtggctggaggccaggacccagcccaggtggacttgacatcatcctctccgtctcctgccagacaaaggctgctcctgcctggccctggccccagggagattttccatgctggccccctttcctagcaggatcactgagatgatatccttcttctaaatggcctccctttcagcaggtgaagtgcagaggcctgcgcagcttcccctcaaggggcagggccctttcccccaaatctggagagaggcagagttgccagaagccttctcctttctcgggagctccactgtgctgacctggatccaaggatggggtgacgtcacagtgactgggaactgtagtcagcctccactgtaacctccaccagtcccaactccctcagaattcagggacatttgatgctcagtccagcctcctcctggccagtgggtgaagtgggcactcaaacaactgattgttcagttggggaggcctcaggcatggtttgtggagagcttgataaaatcttgtgccttaccaatgtttcctccttggtctcctctaaaacaaaatccaccattagattgtcattcctttagacccacaagcctttctctttatgaagatctctcaggactatgcaaaggctacagagaatatttgctgacaatatttgctacagagaatatttgctgacagaactaagggctttacaaagcagttccttacgctagacattcagccctgccctccaggtccactgtccactcttctctgcttactctctgccctgggaggctgacctctgtggcctgaagtacttagactccctcaccgtttgagcaattagagggcaagggagggcaggaagagagagaggtccaggtgtttgttccattggctacttttcaggcttggagtggtcatggctctacacagttgttagctgcatggcactttcccatcatcccctcctggggcaggttaacctgcccgcacctctgtgggtggccccattcatgaacttctcttcagtccctccttggggatgtgttggcagtttcctgccatgttctcactacaacagtgccagatccttattttacacacgagaatgctgagggccagagggcctgggcagcttctctgtacctgttggcaggtggtcagggccaggactccaggggtcttgccccaggacttctgcctttcgcttctgtttgtgaaggtgcctggggagagggtcacgccttgcctgccagcacacctcagggcagaggaggagggaaggcctggagtagggccccctggtttcaggactccagagccagagtgcctctctctcaagagattaaaattagaaggaatcatgcttccttctgggaccagagggaatcccagaagattcttttatctctctcttcaccagcatgggaccatgtgttcaagttagctgaccacatttttataatctgtttcctgtctggtcccttgcatgtgaaggtggttagcaatgtctgaaatacacagatatggcatcaatgacggggtcgtgggggtggggtgaaagcaaacagaatgagtattgtttccttttaggcttcctgggagggtgagtgtgtgagtgtgtgtgagggtgtggatgagagtgtaggagtgagtgtgagtgtgtgagggagagtgtgagagttggtgtgagtgtgtgagggagactgtgaaagtgtgaatgtgcgagggaaagtgtataagtgtgtaggagagcacgggtgaggaagaatacatgaatacataaggaagagtgtgagtgtgagaagaagaatgtgagtttgtgagggagagtgtgactatggaatgtctgagtatgtgaggaggttgttggtatgagtgtgtgagggagagtgtgtaagagggtgtgtgtgagaatgagtgtgtgagaaacaatgagggagtgtgtgaaagtgaatgcgtgaggggaagtgtataagagtgcgtaagagagcatatatgagggagagtacatgagtatgtgaggaagagtattggtgtgagagtgaggagactaagtttgtgagggagagtgtgtgacaggaatgtgtgaatgtgtgagggaaagtgtgtgactttgtgtgtgatgtgagtgttggtgtgagtgtgtgaatgtgtgagggagagtgtgtgactttgtgtgtgatgtgagtgttggtgtgtgtgagggagagtgtgagtggacgctcctgaggcgacagccctggtggtggctaagtggttactgtgggctggggtgccagcccggggcagcttatggcatggggaaggaattctctgggaaccccagagggcctgggctggcaccccacccaccgcgggtgacggctgggtggttgctgcactgagtcagccctctggcctggctccgcccctgccctcttgctgccctatcaggagagaggggctgaggaagcccttcagaactacctgttatttgctccaaaccacaagatggcacagctagctaacatgggggtagcattcccacccctcccaactgcagtcatggagggacagaaagaggttaaagaacagtcagagccaagggtgaaacttgggaaggggatgtgaactctctttacaagaagtcacaggcccagagaggtctgtctgtaccctgtgcaaagtcacaggggagctgggaacgtgtctccaggaggcaactgaggtgggggtggggacatactggtgaaggaggcctagggttcacagctggtagcccctcctaggtccaattgtcctctgtccccccacccccacctcctaggtgaaaccatgaatccagggagagggtctgaggaccaccaccagttcttttttacaggcccaggatggacagagagtggaggtgggcttcctggaagtttcctgctggctcttggaacttgggggtgatgctttgaacgtctttatttctatttatttggggttagaagctgtatattcacatagtccaaaattcaaaagttaagaagggagtgagccaaaggtaatttcctcccaatggagccccatcccctctttggttccccctcctagaggcccctgcaattgctggctccttgtgaatcctgagttcaggatttcttactagagcttgccatcccctctcttccccctctgggagaggttccggtgggaggtgggtatgaggagatatccagccattgacactggggcctggataaggcacccaattgccctggggatggtggtgacctccttcctgggtctgaacttggccccagcttcctagcatcctgctcgagccacccaggaggggtggggcccattacttcttttcacctctttagctcagcatccctggaagttccctgccctccacctaggagacccaggcacctgacagacaccccgagctggggctcccacagtatccttttatctcctgatgtaatttatttatttatttttaaagattatatttatttactcatgagagacacagaggaagaggcaggctctccgcagggagcccgatgtgggactagatcccagacccaggatcacgccctgagccaaaggcagacgctcaaccactgagacacccacgtgtccctcctgatgtaatttatatactctcgccatcttctttctccttgactgttcaaatcttggggtgcctggctggctcagttggcagagcatgcgactcttgatctcagggctgtgagttcgagccccatgttagtgtagagcttattttttaaaaaaattaaacatggctttgttaagcatttattatgtgcctgacctggcctggagacataaagtgaagtggacatagtggcctgctccagtgaagagctcacagttgcctgggggagggccagaaagcggagagatcattacagttcaagatagcccgtgatatgttccttggtagtatgggggggggtataaattccacattaaagagtctgacaatgccaggtgttggtgaggacatgagtcagtgggcacactcccagtggctgatgagagggggaattagaacagccactttgcagagtgatttggcagttctagggaggaacttccctgtgatccagcaattctactttctaagctctttctctagagtttttcaaaacctctgacagtatcctcaaataagcatatattgcacgttcatgacgatgcagttctcaccctgatagttaccctgatgacgtgtgatgtatgttatttttgaatcagtttcgagttttaaaaatgctgatcttcacctgctaaattgatttgacccattaataggtttcaagccatggtttgaacaatgctctcaggagacagggaggcttactgcaacattgctgtcacagcaaaaactgaaatagggctttcacggttaccaacaaaatggatatggtgttgtgacatggtcaggaatggactatcacactgtcacactactgccccatgtattaaaagagacacacagggtgaaaccatctgaagccatctagaatggaaagccctgcagaatgatggtgaattgtgattatagttgtgatacactcatatcatttatgaatacatccctatgtggcataagcataaaaactgtacaaagtgaaacccatatcaggatagtggtcacctctgcagggagagggaagggaatgggattgaggagggataacataggggacttcaactcaatttttaaggttcagttcttttttttttaaaaggttctatttttttatttgagagagaaagagagagaatgagttggggcagggcagggccaaaggagagggagaagcagacttccagctgagcaggcagtcagatgtggggctcgggttcccttccaggaccgtgagatcatgacttcagccaaaggtagatgtttgaccaactaagccacccagctgcatcttaaggttcagatctttaaaaaatatattggaaccaaattttgcaaaatatttacatttggcgaagttagaggaaaggcaccaggccctgactatatttttaatattttatttaatattattatttctttttttttttaagattttatttattgatagagacagagagaggggcagagacacaggcagacacaggggagaagcagactccatgcaggaagcccgacgtgggactcgatcccgggtctccaggatcacaccccaggctgtaggcggcgctaaaccgctgcgccaccagggctgcccaatattattacttcttaaaatattccataataatgcttaggggactgatgttccagaacataagggaaggagattttcttctgactcctggatgggagtagaagggtggagtggagagggaaaccattgagctcaggtgcagtggtaggagtggatgaggccctgagtagggagaatgaacacctagtccttcctaactgggggcgctgtggtgatggctttagcccacttccctcccatgttggcaccacaccggtttccagatggaaacagaggctgggactcgaacccaagcctgtgagtcagagcctgtgctctgagcagtctgcaggatggttcctccttgaagagctgtgtgtctgcccagggagcaggggtagggaggagcggggaagggtggagacagacaggatctggtgcactgagctaagatgtgtagacttgattctgttagtgatgaggagattcaggaggatttcaagcaggggaatagtggagtgaactcactctagctatagcatctgtttcttaaaaaaaatatatatatatatatattataaaaaatataaaataaaaatgttttattaaaaatatattttaaccaacggaacctttctttaagcagactctaattcagaacccagaatctaaaagagcttatggtggagttgatttggcagaagctggtgatgggggcctagagcccagggatggctcccctgggaacacagcatggatgtcatgttccagaaaaatacctggaagtggtgtgtgtggcaggaggctggcagtggcctcccttctcagttggatgagagttgtgctctctccctctttccccgagtcctcctggttggtggagggacagaggttcagagtactcccaggctgggtacggagggagaaacagtggcatgtgcttttgtggggaggtagacctgagctccactgcctggctgggaggccttagctaagttatggaaccatccatctgaatctcaggagcggagaacatggattcctggatgtggcgggcgcaagggaggcacatgtcctgagtgtggccaccaagagggtgcttccagcacatccctcttcatccttgctgggtggggaggggaaaaagcaggccagggttcagctccatcagaggctggtgctcagcagaggccccgcacacagtaggccctcaataaacatttatgaaatgaatgcataggtttacctcctatcagtggaggcctgactcctgggagccagagaggctgttccagcagggctccaggcatggacagtgcccgtccagtgcagtatggagttctagagagagtatggggctgccagtcaggggccgggcttctggctcgggctaccaggaatataccgtgtgaccttgaggtttggtgctctttctctgggcttttgtcatttctttttggcagagaaatctggatgaggttttttttaactgcagttaaatgtgaggtacattaaaaaaagcaattaaatgggtcacaatcagtattgtaaaatgaaacaaaatacagaaatagaacagaaaatatcagagtgcatcaaaggtcatcagggtaagtattgttttgtgaaactattgtttcaattatatatagatagctgtgtggactgtggatgtaaaacgtatttattactgtgggtcttggtaacaaaccgtcaaacatcgagctcagcaatcccgcaggtgccccccccaccgcccccacattctaggggtctctgtggaaaagccacacagccagaactcttctcttcattcccccggggtcagcagctgtctctttactcttcactgcctccatccctccctgggtctctcttcttcctgcttccatccagtcccctcctccctttctcccagggacaacccccccaccccaccctcttcccaggaagtccgggtgggggtttcagaagagagttaaatggggatggcagtggacactcgattccaggagttaagataaaatgattaagaagcaaacacccaagcactcgggaacagaacagaaagtaggcgagctggagacgtgggtttgagggctggactccgtgaaccagagctcggtggcgacaccgcagcgggtcactcccagaggcccggtaccggccttgtcgttgttggcactcggtgcgctattaaccagcgaaggtagctttctcttttgtcacctccccacccccctttaaaaagaaagatagaaggagccaagagtttggagccaactcctggagagggagcggctgaactgattcggaagttggatctctttgtacacaggaatgcggagagaaaaaaacaaaacccaccccattgcttcatttcccctctaagcccaagcgccttctattgtgcaatgaaaaggcttttcacgttgagaaaaatgaatcccgatttgcgctgcgaaggaacgagcgcgtctctgggtgcgagacggctctcagctggggcgctcccgggtgctccgcgcgctgctccaggtagagcctgcgggggcgctggacccccttccgcgcgcgcccgccccggctcgctgcgacccgagggccgagggcagggccgcctggggaaccccgagggcgcggagccccccaccacggccgggcctcccggggatggcggttccgcgagtctgtttgggaactcgttggagctggaactccgaaacgggaagcccgccagagccccaggactccttggagcggcgcggggccggcggctcgttcgcgcccgggaggcccggccccggacgagcgaggggcgcagggcgcagggcgcagggaggcgggcaggcgcacatgggtgcccgcgggccggcggcggcggggtgcgggggggcggggtgtggcttccccgcctcccgggcgggatttgcatgtgtgtgtggcggccccagacttcctgctccttctacgctgcaggtacgcgcgggccgggctgggcgggcgctccgagacgcgggcacctcctcgcccggacgcccccggcggctcccgggccgcgccgcgccgccttccgctccggtggccgctagtctgccccggccgcgccgagcgccccgctcgcgggtgggggcgcgcccctccggcctccgcggtcaccggcgtcctctgcacccagcctggccccgcgccccagagcgcccccaccgccccggggccccggcgggctgcagccatgagcgagatgtccagctttcttcacatcggggacatcgtctccctgtacgccgagggctccgtcaatggcttcatcagcactttggggtgagtgagccgagtccgagggggcgcgggccgggagggggcccgggtgccatttgcgtgcgtctgccgccgcccccggacggaagacctggaagtccccaacttcaaggagcgaggtaacggctcgcctctcttttggagaaaggaagtgaaatgttcgcccaggtagaagtcggagccctccgcgggagttgttgggcgggggcgccccctccgcgaagcctgcacccctgcagacaccccgctcgcctgtctcggagcccggggagaggccacttcctctgcaggtggtcccgggcggggcaggtgggtggctggggcctgagttggggaaaggcatccgggcctggacgtgactggctctgggggtggggcggagctgtgggggaaggcaggctcagcctggagcccggagtcctctagtgacggtccactcgcaccttttccctccggctctctcctgccctgcccgctttcgtcggagcgtcttctccgcgccccccttccaggagtcccaggttctggccgcccccgcccccccctcgccccgcgccccgcctctccctgttaatttcctgcgcggctctcctggcgccccggggtccccggtcccaggatctcccgggcactttacaaacattaattaattctggacgtcaccccccggggtctggatagcagggaatctcttcagatccctggagaggtctaggcccggagcggggcatagggcaggaaaggaattaggcagaacgaataggtttattttcaaaggagcagttgggtgagtcgctggaggtgggggtagcgtggtttctccgcctctccagccaggcttctgggcagggcctgctgtctctgtcccattttcatttcggggacttgtgctaaattgtctcatcctccccaccgcacccagctgtcctttaggatagacccatcctcctctgctccccctactcttcagaccccagccagccacaaggtccctcctccctggagcctttggaggacagccctggaaccctccctcaccccaggcctggctccccctagcctgggaagtgggagtcacctggctctcttggtgtctcccagggttgttgggagtttggctctagtcccattggaaaggggaatccaacaggcctttggggattggaggactagctcggccagcaggggattctcactgggaatttcagtatacctgccctccttgtcctgccacccttttcacgtttctttcccctccccactgagtcgtggattccctagccacagggcctctccccgcactggatcggacagatgttgctcatttccccagaggatggggctggaaccacacgtgggcagcatctggacaggcctccccagagcacttgtccagggggtcctgactgctcctctggccagggctgtgcttgcagcgagcctgcacacagtaggcacacagtaaacacctctgacaacgctgggggaaggacaagtgtgggggaaatgcgggcagatggtggaagcccccctcctactgcctgaacagcactgggggcttttgggaaatgatcatcttctccgttgctcagtgcctgggtcagggctggcacaaagtgggtggattttttgtttttgtttactaatttatttatttgacagcacagagggagcacaagccaggggttggggggcggaggcggcaagcagagggagacggagaagccgattccccatggagcagggagccaatgcaggcttgatctcacaatcccaggaccttgaaaacatgatctgagtagacacttaaccactgagccacccaggcagcccagagtaggcagtttttaagtacttgtgagatctgtcagagtcagggaaagcatcccattccaccctccacacaagtctcatccccccacaagacattctgttgcctcccaacatagcttcctcctgcctctgctctttctgctgcactcccttcctccccacttcctccgggcaggacctggtgacctctgatggcacttctactccagggtgcctgttccctgtgcaaacatctccaacatctccatttgcaccgatggatgcccacctcccagcttggtgctctcacaccctaactgcattttttccccctaacttaattttctattttgtgtttcctacctcccctttcatagactctgcagccctaggtgacactactctgattcctggaacctaccccaggctctaggtctctttacctttgcacctgtgctgcccccgcccttcggccagcctccacctgggtaaatctgacccaccctctaagacctagtgcaaagtgacctcttttgagtgattcagctcctcctcccacaacctgggagaattaacccttcttcctttgtgctttgcgtggctttgcatagactcctctccggtattgtgtttcacaattagttggagggttctctgtagggccatctaatgctgggcattttgccgggattaactaattaattacaccattcatccgctcagcgtgtccacaggccccgtactggccactgagactctgagggagcagtgggtcccacccccttggaacttagagtccgtgagagaatggtctctaaaccctgctaagtcctcacttctgaaagtgtagtcctcggtccagcagcctcacctagatgctagctagaaatacagcaccgcagacctctgcccgtcccgcaaaatctgtgtgctggacctcgtggcatttggtgccttcaagtgtgagctgctttgctctacctcaaactctttctgctctatcctcaccggaatctatctttctttctccttccttcctccccccacccttttttttttcccccacccttttttaaaaaagattttatttattcattcatgagagagagagagagagagggaggcagagacagatggagaagcaggctccatgcaaggagcctgatgtgggactggatcctgtgtctccaggatcatgccctgggcggaaggcaggcgctaaaccgctgagccacccagggatccctccctccctccctccttccctccctccctccctttctctctatctctctctctttcttttcttctttcttctttcttgagagccagagcagagtatgagcaagcggagggacatggcagagggagaaccaggctcgattcacggctggatccccaggaccctgagatcatgacctgagccaaaggcagccatgtaactgactgagccacccaggcacccctcattagaatctttctgctcctgtcttcaactctggtcccctttgaagccttcaccctggctcttgatgcccatgtctgtgaaccctgaaggctgatttgactgagttcccaggctagcctaacacttgatgtctgagaagtgcccagtaaaggctggacaaaatgaatttgttgaagacaggggcggtcttggtgggcagaggggctggtcagctgggaggtgggaaggggggccttggtggaggagggagtcttgggcagccttcagattctggccagactctatggggtgaagtagaggaggtcaattagagctgcctgaataattagagctcctggtgcagattgtacattaactctgggttgggaggatgggaggggtctgggccgtagatcctggagcaggtcaagacctcagcagggaagggaaagcaggcccacgcctgttcttggcaggattgtgtggccagggccactgcctcacaactcaccctgggtgagtgaggccagggctggagtgactgaaaaggagcagtgaaaggtagagaatttatgattgttcctggccagcagatgtgaggaactggtcctgagtgtgcagggtgggccgctcagagtctgacatccagtttcttgaagatccctctgggtgaccagaggggtgggcccccacccacagggaatcagttggggagggtaggtgagctgggtcttgaggctgagctcctgacatttgtcaaagtgccttggagcaccatctggggggggggtctcagggcctctgaacctgcgtcacccagggctgggtgatcacagggagtagggtccaaaggggcctccccttgggcttccctgtccaccttccagcctgattcacttccccaggagggtggacactggaggtcagcaccctgaaaacacagaggtaaatgtggaagaaggcccagttccccagggtcaggacccttgggttggcagccccaggggcccagctttcctggcttgtcactaactcgctgggtgactttggcagggcactgccttctcagagtgtgtttctgtcagtctggatagcctctaaaggtgctctgtttgcacccgagaatccccctgggttctttaaaaaacatttcagcttctgagtcccatgtcagaccaattgtatcaatatttctagggctgggatctgacagttgttgttgttgttgttgttgttttaaactccccagggattttacctgggtggggatccctgatctaagggccctcttcagctgataggctgtgaggaagcctacctgttggatccacctgccccttgctccagagagcccatctcttagccctcttcagacttcagtaagtcattcaacaaacattaactgagcacctactttgtgccagacactgttctaggcactggggaatcaatagtacccaagataattccagcctgtcttagtctataccctgggagaactgggtgaggaggtctggaagggccctttcaaccttaaatctctgagacacatgtaatcccaggggggagggcactgcccctctcatgcagactgcatttctggggcaactttcagacctgcccttggctctcctttaatcgtgatttccctggagatactggaagtccccctgtcctgtgccccagggcagggtcttggcctcagctaggctgattcatgtaacttattttttaaaaatacatattttggggggtacctgggtagttgaattggttgagcatcctactcttgatttcagctcaggtcttaatcttagggtcctgagttcaagccccatgttgggctctatgcttggcatggagcctacttaaaacacaaaaacaaaaacacacacttaaaagaaatatgttttcttttttgttcaagaataatgtatgtcccatggaaaaactggaaaaactcaaataaaaaattatgtgtgatactactgtgacttacatgaacattctgtatgtggatcttttagtcttctttttttttttaactttcgatctacacaaacgtttacaaaacgatgtcaaactgcacaggtagattcgtattctgtcattttgggaggatacattaagctgtattttctaatgccgacaggccattgttatggctgcacagcatcgcacggtatgatttatcctaattaattcaagcaactctagtcttaggcgttcaggttgtttctaaatttttgcactataaacaatctgcacagaacatcctagtccatacatgcccgaacacttgtccagttatcctctcgggctaaattcccagcagtggaattctgagatcaaaaggaaggtccatctttccctcataggctctaactctgtctatgtggtggtagaggtgctgcaaaggtggccctgtgccccaggggggttctgactccacttcatggcctaaatttgagagtgtggtactaggaggtatggggagaaagatcagcctccgcccttgaagttggatgtggtggctgtgatggagaggggtgaagtgaggagaggagcttgtgtggggtttgctcgaggacagaataggccccggggttcggccgtgggacgccagggacccaggctgcatccaattccctggccctaaagaatcttgctgtagccacttttcacactctgccctgccccacattcctgaccctacatccccttcccttcccagtggggttgtggggtgggtggggcagtggcttgggttgggggtggggtgatgtgctggattttaaggtgaggccacaccagccttctgctcacagctcagggggcggtttctgagttttgattgcttctgagactgggtccggagtctctgtagtcgactccaggcctgttgtccatgctccccccacccccatgtggagataggggctccgccctagaagtgggggctgtgagagaggaggagaggaggtctgggagaggggagtagggcagagcccagatctcaaataagtttcatcattggcctctgagtgtgagctctgagctgccctgagtgtgtcacattggtcacgctggcactggtacccagcatttgcccccgacagtcacagttccctgcagtgaagacccctggggtagaaaggctaaaggacttgccccgggtcacatagcacgggtctgtagagaggaggccgcagggcctttcacaccagtgactgtgggccacagagatgagtctacgtctggacaactcagcgagcccagggtgtgggtgggggctggggctgggtagggacactttgcagaggggtttccacttggggagataggcagggagggaatctgcagggagcagagtacaatgatcccggtggtgtgtaaatatgggcatttgggggttggcaggtgggtagagccagaagaggcagtgaacataaatctcaggctccccccctccaccggggggtgggggtgggcagctgcaggtgttggtgcagacacctgtgtgtatttggttcacaaatccctcccattactcagccagccagctagcacccccttcctccagcctgcaggagtgctgtcctctcaggccgtgagtctagaaatgggtgaccagagtgatttaggtcatgggaggcagaatcaagtctgcatctccgagatgctgctgctgctggtagtgggtagactttattgagctcttatgcggtggctctggcctttacctgtcactttggcccctcaccactggcctgaggcatacatataattcaagacactcaaatgcccactacttagacttaataattgtccacattttgccatatatgatgaatccattttttttgcccaagtattttatggtaaattacataattgcgtgttttcacctctaaatacttcattacacagctgcaagaaataaggatatgttcctgtgtgaccatagtactggcatcacaccctttaataatttatccgatgcccagcctgaactcagatgtgccccattgtcctagtgtgtctttgaccactggtttctttagttcaggatccagtcaaggtccacgcattattggggcagcctgggtggctcagcggtttagcgacgccttcagcccagggcctgatcctggagacacgggatcgagtcccatgtcgggctccctgcgtggagcttgcttttccctctgtctgtgtctccgactgtgtctctgcctcttgcgagctctgtgtgtgtgtgtgtgtgtgtgtgtgtgtgtgtctctcatgaataaataaataaaatctttattaaaaaaaaaagtccatgtgttacatttgattcttagtcccccacctcttgttacatttgattcttaggcccccacctctttctttgccatgatgatcctgagttcctgacaagacagagctggttatgccatagactgtctcactctctggatctgtcagggctgtttttgctgccctgtttcccagagagctctgtggcagtccagagcggggtggcggggccttggggcctgcctggctgagccctgaggcttcagttactttggcgagcaggacaggctgagtccagagagcaggagaaaggcctggtcctggcaagcccagtggatgaggtgagtgccggccaggggtatggctcctgcttgcacctcctctgtcccttttcagcttcccctcatgtctctctagttccctgtccctcttcttagcctaagaggcatatcttcctgtgtccccagcagcactgttgagaccccagcccttgccagagcccaccagtcctgagagccagaaacccaggcctgtgggtagaaggtttgtacatttagccttgtacatttagccagggatctttctttctcttgggccaaatttgtcatttttgccacctccatgcatcactggagagattctcggggttccctgagcatgtggcttacctgtcctttctagatgtaagctctctgaagagaaagcctacctgcctgcctattggtccagagtctatatctcagccttcgtcggacttcatgaagtcattcaacaaacatttattgatccatgctcatttaagttccatatactggcccctctggtggcatatggtggatccttggtacagaaagatagggagaggttaagtaaatggatatttttgcagggatgcagaaatgaatttcttttccctgatgagccagggatcccagccagtgaacctaggttcctctcccaaccttcttccccacccccatctagtgggtgtgactttgggtatttggagaaagggactccaaggcctgtgtctaccacaagccaatcccagtagtctaacagtggcttcattgggagtggccttccttgagtctggcctagatttgtggggcagtggccagtgtcctgggctggagtcagagatctggggtctggaactggctattcctttgacttgttgtgtgaccttggcagtttcccctctgtgcctcagtttccaagctagattggggggggctgtctagagtctctgattccctgtcctgtggctgctctgagggtggccatgctggtgggtgcaggctttgattcagactcgtctgatcgtcacttgctccacctctagctcaattcttccttcttatctaatctttccagacagcattgacccgcctcactgcctttcctgtggctcccacctggatctcaaagtgcagccagggcaaaatggggccactcaggtcactggatgcatctaccttcctctttttcccccaaacaagctcttggggtgcagaccccatgggcatttcaaggacggcaccctcctccacaactttgtagtgcagacttgtcaaccatctcctttcaaagggttcagggcagggccccctgggtggctcagtggttgaatacctgccttcagcccagggcatgatcccgggatcctggaatcgagtcccgcatcgggctccctgcctggagcctgcttctccctctgcctgtgtctctgcctctctctctctgtgtctctcatgaataaataaataaaatctttaaacaaaaaaacccccaaacaacaaagggtccagggcagccctgaacacaggcctcctgtcaggccctccccacttaccctcatcccactgcccactttgctgatggcctcttgggccctgtgtagtccaggctcaaactggctttgtgcctcccagtgggtagaaggctcctagcaggctctgtcctcaaagctccctagtgtcctctggacaggccctgaggtgggtagatgcaggggtctaggacatagtggcccctgtcctcagggcaatcagcatggtggttatgagcttcttgactccacctcgcccgtaatggcttcgttgtaaggttttgttgaatgcatggagatctagcttgtacatgtgccatcaactgaccagagcggggtgagtgcccgccaggggcatggggtggtgggtggggctggggatggtggtgtggtgttgagttttactcagtgaacctcacactaaactgtggtgagaatagaattaggtattggatataaaaacagcttataaattaaaacaggttcagcacattggaaggttggattttctactgtggtcgaggctggggtgccacctgcttttagatgaggggcggcgtcggtggtaggaccaggcggggaactctgcaggagcctaggcacggccttgaagacggcaggacttggcaggactcggacagggctctggtgtgcgaacgcctggacgtgggacgatgagatcagcgggcggcggggggtgggagcaggcctttgccgggaccttgggcggagaccggggctctcgggagggctggggagggtgaggcgccgccgccgctttcgccggagagctcggctctggtcaccgcgccaggtgcggaccgaggccgggcacctgtgacccgggtccggccagtttaataaatacagatgccccggtgagggagagtggggggtgcggccctggccgtgggtgccgccggcgcggggtgcggggggagaggtcgggaacgcggccgcggcgctcgtcaccctcccgcccccgcgcacttgcagtcgagacaggcggggcgaggcggggcgaggcggggcgaggcggggcgacgctgcgcgtggggcggcgggtttcgctggggcgcgggcagagagcacccagcggaccccgcccggccccccagcgcgctcccttccgaggcgctgcgcccgcggaactcggcctccccccgcccggtctccccgcagcccgtcggataggcgcggcctgctctcccctcgccggcgcccgggctcccacggggctgcctcggcccggcccggcccatgagaacacacaggaatggagggaggctttcgcggggcgcttggggacatttgggactccacacatcctgccgatggcttctctgcttgccggccacgtggggagctgccctaggcaccaggtgggaaataaagcgatgagtagggcaaggggccgcggtcagacgctcctgggggcggggaggggacggggtcggggtgaagcccagcgtccccaggccgcatggactgtgcactacccccaccgcacatggaggccgcaggctgtgcaacgttagaaccaggaggaacccctgaagtccccatctactgcccttgttttcctgataccttcggggaacacccctgcctcttgtatcctcccactttgcttctttcctctggtccctcctacacaaggtccctcagctgcggtgggtccaggatggtttccttcctgaccttgtttgaagtcctcctgaggccatgtccccctcctgatcaatccctgccttcccctatgtggtttcagctcacgctcccaaaatataccatgctttgtagacctcagtgcactgcgaggggctgcgtggagccctgccagagtgggaggggacaaacggacagccccggatcgcggggtagatttgtgccaggggggttaggaaaagcatgccaggcatctgaattttcgtgtgtttttcctgcacgtgtggcccagacgaggagtttccagggctgctgtggaggggtcaggctgaggatggatttctcctcgatcagagaagctctgaggaggtggcctccccaaggcttgagcgctggacaagataggggctgttacgggctaccccagcctgccctcaaccacactcacttccatgatgccctgtggctgtccagcacccttggcagtgccaggtcctaggccagggcctcctcccctcccccatccaatcatagccattcgggttccctcccttcagggctttgctaagagacaagcagctaatctgattcactaatgtcttacaggaaactctatgaattattcaaggctctgtatagctcctgcctcttctttcgcaccttctctgattggccaagctctgacctgttctttccctgaatttggacaaaatccacagctggtaccaccagttggcactaatacatattcttcataacattaactcttctgagaatgtgacttgtcttcccaaggagatttttaaactcctcgagtcagggacctaccttaccttttgcttctcaaatactttcctcagcagctagtcaaatgaattaattcattccatgtatgccctctctgtgccaggcagtggtctagattctggggatacagcaggaagcaaaacagacacatccctgtcctcatggatcttccatcccaagtgtaggggggttgtaaccaaaatagataagtaaaatatacaacaggtcaggtgatgagaaatattatgggcacagtgaggcggcggcgaagaatgaggagtgtgagaaagagcagttctgagttttaaaacagatagggaaggcagcccggtggctcagcggtttagtgccgccttcagcccaggacctgatcctggagacctgggatcaagtcccacgtcgggctccctgcatggaacctgcttctccctctccctgtgtctctgcctctctctctctctctctctgtgtgtctctcatgaattaaaaacaaacaaacaaacaaaacaaaacaacaacaacaaaaacagatagggagatgggtgcctgggtggctcagcggtttagcgtctgccttccactcaggttgtgatcccaaggtcccgggatcgagtcctatatcgggctccctgcagggagcctgcttttccctctgtctgtgtctttgcctctctgtgtgtctctcatgaataaataaataaaatcctaaaaaaaaaatgaaaatgaaatggttaggaagggagggcgttcaggggaatggccatttgagtggggatctgaaggaggtgagggagggagccagaagggtgtctgagggcagacaaaagaactagtgccgaatctcctggaaggtttgaggaacctaggggagggttgtgggctggagtgaagtgggcagggggtagagggaggggatgaggtcagagaggtgagggctgggtcatgtaggttcaggccattgtgaattcttggcttttactcagataggtagttctggagggttctgagcagaggatgttcttgatttgactcaccttttaacgtaaaggtgtgaggcgtgtgtgtgtgtgctgtgtggagaacaggtcttagggagatgaggggggcacatcaggaggtcagtaaggaggcagttactcacatccaggtgatagctggtgggggcttgggtcaggtggtggtggcaaagatgaaaagtggtcagactccacacagatctggaagatagaacctgcagggtttcctcacatattgggtgtgagaggtgaatggaagaggagccaaagattggctcaaggttttttggccccagcagtgagaaggatggattgccaccaactgagattgggaggactttaagaggagcccatttaggtggcagatgaggagctcagttttgaacctgttgagtctgagatccccgtggtcagccaagcagaggtgttagatgtaggatctggcctttgcgggggagatggatatgggagtcattgatgagtgtctgagtggtcctttgaacctgtgagtgtggctgagatgtgcaaggaagggtatgcgagcagatagcagagggaagagggccaagctctgagccagtgctgcgggccagagagagggaaggagaccaaagggtcctcctcacagagcaagctgcctctctgctccccatcattgtgaggtcctgcacaacatctgctctgacgcttctcagccggcttcaaaaccaatccttctgcttgctggctgtgtgtccctggccagattgtttacctctctgtactctggcttccctgctcaccaaatggaaataataacaaagtggatttagaaaattaaataatgatatatgaaaatattagaaacaaaatcctgcttgctttcattattcttattgatgacataagtgctgttgatgccaaagagaaaaacagggtcctgtcctcaagaagcccatagtgtagacatggcaactagttgcagtaggaagagacatggcaacaggagaggccaggaccggggcgcctgggtggctcagtggttgagcgtctgccttcagctcaggtcatgatcccggggtcctgggatcgagtcccgcatcgggctcccaacagggagcctgcttctccctctgcctgtgtctctgcctctctctgtgtctctcatgaataagtgaataaaatctttaaaaaaagagaggggggggggcaggaccaggtgcttcgggaacatggaggaaggaggcccagtgggaaggagggcactggcactggccaaggaaggtttcacagagtagagggagggtctgagtgtggaagaattaagtgaggtctgctaggcctgggtcttggtgggaagccaggatgggttgggcatgaacggcattgtaggctgccactgcagaggtggtcacctctgtagagatgagagctccagggaccttgggatcaactggagatttagcatggttggagcaagaagttgtgaggctagctagggaatggatagaggtcagaccacaaaagaccttgttagccaacccaaggaggggaggagaaggaggttttggaatcagctctttgacttcaggcaaattatctcaccttcaaagtcagtttcctcttctgttaaatggtgttaatgactagaccctgggaggaagttggtgagaattcatagggaacagttgtgaagtgctgaaatagacctggcctctgaaatggtggatcgttatcatcactgtatcctagaggctgggatggcattgaagacttttaaatgcaggaatggaaggaagggtagatgggtgggtgagtgagtgggtggatggatggattggtggctggctggatagatagatgggtgggtgggtagatgtcctccagagattcaggattaagcccagttgcagtttaaggggggaggggatttggggccctagggtaggcctatagggagggaatggaatgcagcctgactgaggttgagaaagtgcaaggttcattgtcctgtcttggagaccaaaggactgtccccctagtttgaggtctcataaacttctgtttgtctatctctagtgtctctctgcctctgtatcctacttatttttctgattctattgatcttttctgttctctttctctgtctctcccttctgatctgtctgacttcatctccgtctctcttagcgcctttccctctccttcctccattacccactgcccttaggtcggggcggcagggtctcagggctttcacgggagttgcatctacagcatgtggcagcccaggctggaggagacccccctcacaagacagctctagctctgtcaggcagagggggtggcctgggtgtgtctctgtgcttttcctggggtcccccagccccagcccccaaagaccttgccttctaacctccgtgccaggaaagggaaagccttgatgcgttgaggggggagcgtgacagtgatggagagggattttttggaggcttccctggtgccctggcatcccctgccctggggagatggcgtcttccctcccactgaccgagctgccttgtccctcaggttggtggatgaccgctgtgtggtggagccggccgcgggggacctggacaacccccctaagaagttccgaggtgagactcccgcccccataccagcctcccctccgaggctgtaggtcctggacctgggacgagcccgttcaaccccagccagcgctcccacggcccggcagccctcatgctgctctctgtggaagccccccatggttgtctggggccgcccccaacttctcaagggcatacccacttctggcagagggccgtcctcccccaaaccccccatcagccacaaggccacctttgtctgcctgactgggcattttcttagctggcaggggtgtgggagaatttcctcaggcttcaggaggcccagggtgagagctcttcctgggggcttctggtctcctcatctgcctggcgaggttgttgggcccttctcctgccccctgctgtgtccccagccccatgtggatgacgccagccctgggggaactcatggatcccgggcagggccctgctgcctgacactgggcaggggcctccgtgtcctccgtggtcagtgggctcctcagccgccccgcaggcccaagggcgctgagagaattaaatgatatcctgctgtcaccgtgcccagccggggtgaggtattgttgtgattgcctatgaggctgagacagacaatcagacggatcctgggcgtggtgggcagggtgggagcaagcagggacatgccgggctgctgccaccttgcctgcccacgtggctgctcctctggggagagattagctgggattgtcctccagggggatgctgggagggaagcggggtttaagataatcctgtggcatccttggccgtctgtctgctggggccttgcccatccaccggagggtggaggagagggagggggaccttcctcgcccgcaggggggccctgtacctgctgttctgcttctgcttttctcccaggcctctgagtggggctgtgtgggggtctcaggtcaggctgtgcccaggtgtgtgggaaccgcctctggcactggacgtgcctcaccactgaacacgcctcggccctgcgccatctggccccgctgcccctctcacctcctcccctaccccttgccctgtctcattccctccagccacactgcctccctgctgttttcatgtatctacctctgcacctttttactcgttccctccgcctggaaggttcttgctccaaatactcacctggcttgcacggcagtctcctgtcctcagtgggcccgtccctgatcacctcatataaaattgcacccctgtctctcttccctgctttccctctcttcacggcatgagtctgacacactccgcgtattttagttatttgttttccatccgtggagctagaatgtcagctccaccagggcaggtattctggttgttttgttcactgtttcagtgggtggtacacatctgaggaataaatgcaggcagcagcccctcctcaggcttcctcccacccctgccacctctctcaggcctggctgctctagttcccactgctgtgatgacccgtccggaatctctcagctgaacccagccttgaaggcactgggcccgggctttggggatttcagggtgctcgtgcggggtgccctgcttggaggcacagctctgaccatgcctgcttctgggtcctgatgattgagacggggcctgtgtctctcctggaggcagaagtagtagagctttggggatgcctgcgtggctcagaggttgagcatctgccctcagctcagggtatgatcccagggtctggagatcgagtcctgtatcaggcttctcgcacacagcctgctacaggcttctccctctgcctgtgtctctgcttctctctctctctctgtctcatgaataaataaataaagtcttaaaaaaaaaaaagtaggagagctttgaagccactgacagaggggcagatttccactctagttgggggatttaggtaaattcttgggaagaagttagtaagggtgagggtccctagggtgggctgtgccagggcagagaggggcctgggactggaaagggaaggtgtgtgcatgtgtcaaggtgtatgtagccagctgtgtggtgtgacagtggtgacagggaggtgggtgtgacagagaaagatttgccctagagttccagtggacagagtttggggccaatttctgacacaaaaaagccgctcagcagaacaaatactcttttgacttctcatcctcctctcccattggtccttcctagtctcttctttctcttcctctccatcatcccaaagcctgtgagtggggccctccccaaggtcggggtggggggagagggaaatgccccatggtccctgtggcctcaccgtgcccagccagctcagagaggtgggagagaggactcagcctccagcctcctccctgccctctctgccccaggtgtcctgaagcagaggcccatctgaactccctgtggccctatttggacctgagaaaaactgattttctgagacagaacccaggctctgtgcagcccagtggctggtgtgtacagttgaagtgttagaacttgggacaagagacatggcctccaacgtgttcattttgactgaagcccggaggagagaaaagcagagcttggcctcacgcctgggagtcctggttctcattgttctgcatctctccctaaataccctggactggaaggaggtcctggcagagccatggggaccatggcaggtgtgttggaagttggctagatgttgttagagatggctgtgtcctgaggccccgtaagtactgtcctgccatcctgggctggaccccgccattgcgaggaactctggtttcaccctttctcctgctacagcttggttgtcctcacatgctgaccctggaggcccccaggctgagtgggcaaagcccagtgaagctcccagcctgcctccatcagcccctgattggcttcttggttgtggtttcagctctaaccatcatctgaggccattccaagccctcacatgttctgggaattctttccagagtctgcaggctgtggggaggcccaggctactggtgctccaatgtgtagggcacctcactccagcccaccatccctgacctttgctttgctgtaggagtcttggggagatggctgctctgagttgtgtgctgctgactgggtccagagcctgggcatgttccctcccatgtgggggcatggggaggggcagctctcgcctcccagtctaccttagggaggctcagagcccatacaccaagctacagggaccccaggaatgtatgtaggggccacttaccccctgagactgttgcagtggggagttggtgttggggaggaggctgatgaaccggccttcctgtgtttatatggctgggtgccccccaactcccccaagctgtgcttctgctctacatgtcctgccttccaagcccagtttattgtttttttattatatatatgggggggctgggggagcgcagctaggaggaggagctgaggggaagggagagggaaacagtctccagcagactccaccctgagcgcagagcctgatgtggggctccatccacatccgtgagccctgacaagggttggactcaatcgaccgacttacctaggtaccccagaccttgtcattttttttttaagattttatttattcattcatagagacagagagagggagagagagaggcagagacacaggcagagggagaagcaggctccacgcagggagcccgacgtgggactcgatccagggtctccaggatcaagccctgggctgcaggcagcgctaaaccgctgcgccaccggggctgcccagaccttgtcatttttattttttatttattttatttatttttttaaatgaccctttaaaaaaaatttatttattatttatgatagtcacacacacacagagagaggcagagacacaggcagagggagaagcaggctccatgcaccgggagcccgacatgggattcgatcgtgggtctccaggatcgcgccctgggccaaaggcaggcgccaaaccgctgcgccacccagggatcccgaccttgtcatttttaaagcatcttatgcctgtcactgaggccctcggtcctctccctgacccctcttccctccctccctctccagaggcaaatactcatcagaaattgatgtgtatcggggcgcctggggggctcagtcaggttggtgtctgcctttggctcaggtcatgatcctggggtcccgggatggggccccatgttgggctccttgctcaggggggactctgcttctccctcaccctctgcccctccccccatcccctgctcatgctttctctcaagtaaatgagtaaaatcttaaaaaaaaaaaaaaaaagaaattgttgtgtatcattccagagcctgattttatactttcgctattaatacatagggctattataactaacacagagtatttcccatttttataaccctgtatattaaattttttctgcacatttttcattctgcactttaaaaaaatattttctttatttgacatgaagagagagagagagcacaagcaggggaagtggcaggcagagggaaagggagaagcagacccctcctccactactgagtggagatccagatgtgggactcgatcccaggactctaagatcatgacctgagccaaaggcagacgctcaactgactgagccacccaggcgtccctattccgcattgtttttgagatttctccatgttgatgcatgtggctctagttcatctggttaattgctgtgtaatattccactgggtgaataaactgcaagccatttatcctttctcctgtggatggacatttagctcatctccagctgttggcagctggcagccatgctgcagtgagcattcccatacatgtctccttgggcccgtgtgcccgagagtttcttgggtgtgttccgaggtagggggagccctggtgtgaggaggcccttttgagccttcctctggggctgtgtgtgctcatccccctacagattgtgggcacgcccccccccccactcccaccagcgatcttgccacatctggttctgtcccacttaaatttcttccagcctgctgggtgtgaaatggcatctcactgtggttttaatttgcattcctctgatgactagtgaaatggagcatcttttcatgtttattggccacttaaaattctgtacttacctgcccaccctctcccgcacccccagtttataaaagtaatgcaaacactttccaggggcaaccatatagaaaaacagacttagtaatttattcatatggttaaaacatcaaaaccttgtacaaagaagtatagagggtctgctcccacctgcgtggtctcctcacttccctcctctaccatgatccctgccagtgaccactttcctgagttacttatgcttcttccaggtttcttcaaatataaacatatattcaggatcccaccccctacttttcttacacaaaggtaggattctgtatacgccattctttttttgttgttctttataaagcttactatggatcctactggagaccttttcatattagcatatagagatttctctgttttttccttcatttaaacactcatttttgttctgtatcccagacaactgtgtgaaaatagtgtttctacgacttgcctggtttgaaacatttagaaaatatttattttaaaattgtggtaaagatccataacaaaacgtttccatccttggacacctgggtagctcagtgattgagcatctgcctctggctcaggtcgtgatcttggggtcctgggatcgagtcctggatcaggctccccacagagagcctgcttctccctctgcctatgtctctgcctctctctgtgtctctcatgaataaataaatttaaaaagaaaaagtttcccatctttaaccatttttaggtgtatggttcagtggcattaagcacattctcactgttttacagccaccaccaccatccaggaacttttgtcttcctataaaactgaatctctaaactgttaaataattaccaccgcatccctcctccttagccaccatgctactttccatctctatcaatttgactatttcagtacccacatgagtggaatcatccaatatttgtcctttggtgactgggttcttttgcttagtaagacagcctcaaggtttactcacgtgtagtgtgtgtcagaatttctgacctctctctctcttttgcagctgcagagcattccattatgtggctctgttggaatgtatttagccagtcccctttgtttttttttttttttttttttttaatttttatttatttatgatagtcacagagagagagagagagagagagagagaggcagagggagaagcaggctccatgcactgggagcccgacgtgggattcgatcccgggtctccaggatcgcgccctgggccaaaggcaggcgccaaaccgctgcgccacccagggatcccagccagtcccctttgatgggcacttgggctcttcctaatctccatcttctccaatagtgctgtgggtgaagacccttgtcttttgtcatgttgtacaaacggaggtgcgctcttggaaggtggaccagcagtgagatggctgagtcgaggggcaggggcagctggaatcagtgtcgtaggagaaggcagccccttccaactctccattgttccttctgttccctcccagatctctcagtgttttagctcattccaggagaatttagctcccttggccactcctccacttcctctgccccatcctccctaggcagcctggtggcgattccccattgtcacctccaggaacccagggatcatcagttccaccttcatttctctgcagccagcaaccccggatgctgccccacaccccctccctctgctatcaggtgcactttcagttttacatagagactgaacaaccttgcctttctcttctgtaaccacaatgaagtcttccgtgttttgttcaataggtcgagtctctaactgtcgaaaataattagaagcagatgtttacatgatttacactgagcttatatgtgactatgactgtagaactttattccctgtgctctgttctcatctcgagtcctcagcactggtacttttgaatcgtatcggagcagcagaactatttggggtcaggggtgcctttactaatgcatacccctcaggctcatgaatctatgcaggacctgggagtttgtattttttttttaagatttaattaatttatttcattttacttattttatttttaagattttatttatttactcatgagagacacaggcagagggaggagcaggctccatgcagggagcctgatgtgggactccatcccggcactttgggatcatgcctaagctgaaggccacccagatgtccctaattaatttattttaaagagagcatgaactaggggagggttagggggagagggagagagagaatctcaagtagactccatgctgagtgcagagctcgacccaggactcgatctcatgacctgggattatgaactgagctgaaaccaagagtcagatactcacctggctgagccacccaggtgccccaggagtttgttttctaaagcttccccactggcagtagcttttggagtattacaaacttgagtttaagggaaggtcactcgacttcatttactatgtgaatatcctcttgtctgcagcctcacaggccctgtgccccctcaactgcaagttcatgtcccccaacacacacagtccttactgttggagtcctccctggacccagacttttctcttggccttcgatgctgctgctccggtgtgagcccagtctcctggccaccctcccatctttcttcttctctgcctttctgccctgtggtttggtgagaagaaaggttccagccccttctggggtcctggcagggctgcctttgggccgaaagcaccgtgaaagcatggaggtgtgtgtagagatgggccacagacgttttaggggactcaagtcattcgttcatccaacaagcatttcctgacaggtattatgggcaaggctctaagggagatctgtgtgtgagagaaagagacaggttagacaagtgctagggagtctgtttccaagacaggagagtcgggagtagggagggctcatttctggcttccttcccactcccaggatgctcctgggcggggtgtttcattcaaactcaggctctgaccctttagtggccgtgtgaggtccctctaatggggctccaccatcctttaaagacctgcatagaatagaattcgagtgcatcaccataggaggggtcgttcatatttcattaattcttccttcagctccttccttcctgttaaatatgttcaaggagttttaaatgtggttattgaagctttcttatttctagagattccatggcgttctttttcagcctttgatgttacttatgttactttttatagtttcctcctctctgcagggatcttcaaagttttgtggatttaagcagagtaggctatctgttctgcagatgttgtctgtgcctgaagtctcttcgcgtctgtttctactctctgtttggtgggttggttctctctcatgacagctagttcctgagagttcctggttagctttgactgcacactggagtgcagtcagtgtttgaaaaaattggtgtgactggttgtggactaggaggaaggtacctttctccagagaggacgggtgtgtgtgtatcctattacgagactcctggcactccacttgtccaagactgcctgaagctgggctcaggtttggggtttctgtagcatccaggagattctagcaaggctctggtttctagaaggagctgttctgcctcgggttcagccttcacttgggggtgtagcccagcgcagttccagcttattgaacggagggtatcctcttagattctcaccttctgtgggcctgggtttggatttctgcaccaccaccctccatcacctgatgaagccatccaaataaaagcctatttctggaatcagtgaatatcctcagggtgaaagtagcttgggtgtttctatatctttctgacttccctttgatcctctgcttgggcccaataattcttcgctattttgtcagttctttaagaagtcttaaaataatatccatttgaaaaatccagttgtgttagttgctttctggttggattgatccaaaagatatcataaccacggtttttagccctgtcagagactgccccccttaccagggacagacgctcctgccatgttgtttcatgaaatggtgatccaaaaatatatttcctgggtgagccagttcagaaagcttgagaacctctgctctagggcgacctggggcagcatctctctttccttctgttcgcctttctggactgggagtggtgggggtgtggaggagtaggggtgcagggagaccagggatctcatgatcaccaagacctgcgggctccaggctcattcagacccagggccctggcctgcctccgcccatcccagttggccagaccccaagtgtgactggctgctgacacttcactgccccttccaccactctcttgcccgtccctccatttgcagtgcctcatccctttcctcccttctcggctataaattcagccccatctcatccacatgagagagtcatttctagattcatgcattcatctggcagatactcgctgagcccaggctagaggctggggacatggtgatgagctccacatggccctgcccacctgcagatgagcctgtcagaatcagagtattatgaagtagaattcaaaaataacacaatcgatgcatgtctatatttatgcaatataaaatgggcgtccaggggcagggtctgagtgaccctggagctgggaggagggagcgaggtcaatgcaatgtcctaagtgtgataaaaaagaataaaggggagcaatttataatgaaataatacacattttagaagtagatgttggacacaactagaagacccaaggaagcagtcagagcttgcctgtgaatcatgaatagggcagccacaaacgcaagcatgtggtccagccacgagtgatacattctctgaaacagcaaaacaaatgaaaagaaaaacaaaaaaactcctggtaaaattggaacaatacaaagaacacaaattccctcagtttatatctgagttgcattcccaaacaattcagcatttgctaaaaccatgcagaaaatgctttgtgtttctgtgtgcccctctgggctcacagccctgcccgcggctatctacctgccagtgtgtggcaggatgctctcggcaggagtcatgccggacaatatttatggtgcaggtggtcagcatccctgtcctgaccactgaacgcccactgttacctctactgggacaaccacttttccctaccccttcgcaaaacaatccctggcatggtccccttctccgacttctgctgggaactggtggcctccatgtggtaactgggggacctggggagcccttgggagctccaacccagcctgaagaagcagtaggacttcctggagggggtgacacctgagctgcttcttgagggctaagcaggtccttgtaaagacatactctccccagcaaactgagtgcttatttccagaagtgatggccgttcgtgctggtggtgccaaggtgggccaggcatggcaggccttggtgactctatccacttatggaattgtgtttcccccctcccttcttggaaattctgtctttgaattttgactcattcagtctttctgcctgttcatgggctagatagaaaacccagttttgcttttagttcctgggggctggatgaccagctctgacccgagcaggcatctggccttctttcggagggcagaaggagagggcctgaaggaggggctccccagcagctcccttccaggtgctccagcacagccatccccgtcctgggcacatgcccctggagcctgagcagtcatgcagaggtctcacgggccatgaacccagctccctgtccaggctgtgattccctcctgtgacagggaacttgctgcctcgtagcacagcccatggcattgtcaacgcggcccagccactgtgctagcacttccccatgacccagaaccttccatctcctcctgccacactttttatttatttcagagagagaaagcaagagacagagcacgaacagaggaggaggggcagagacagagggagccgcagactcccccctgagcagggagcctgctgtggggctcgatcccagaaccccaggatcatggcctgagccgaaggcagatgcttagtccactgagccaccctggtgcccctgccgtgctttagaataggattttccaactcatgcctcctttggataagtagaaacatcggacgccctatctggagtttgggcttacataaaatcataggtgttttgtctactttgcaaaataaaaataagaatggtgaagctgcttctgaaattttgatgggcttgatctcaggtcgagatccctggaagcagaactgattaaggaggggtcttgagaggacggagtgagggagccttgcccattcagggcaggggaagagccaagcaaggatgtggtttcagggcgaataggaacctcagcctggtcctgcggggatttggggagtgaccagcagtgcagacaggtcacctccagaggccagatggttctgtgcctgtgtcagccacttggagcgagctgctcctgagccatgtgggggataggctataacttcccagatatctgtgggcgacaaggcagtgggtcagagaaggatggcaggtattagctggcagccaccaatgtccacaagagctggcacagatgggacaaggggtggggccccaggagcctctgatgaatctgccatgggggagagggcccgtgtctgccttccatgtgggatcttgctctcacgccttctccaagttcttcggggttattccaaccactagctctccaccctggtggggcagagaggctgaggagggatggggagagtggaggtgcgattgggggccgggtcacgggccgagccccgcgtgaactgatcgccctcccacagactgcctcttcaaggtgtgtcccatgaaccgctactcggcccagaagcagtactggaaggccaaacagaccaagcaggacaaggagaagatcgccgatgtggtccttctccagaagttgcaggtgggtgtgctcaggtgtgcagctgcatgtgtactgcgggaactgggcacacactggggtccgctgctcatcgaagccaaagggggccgtggcctagtcaaaaaccccagtatgagagcaatgggtatgctgggctgtgaatgaggtgaaagaggggaagtagagtgctttcccggtgatccgctcatctctatgaccttctgtgccagttaggagaaggtgctccttcctccaggctggcatagccctctgctctgggcacatggctcagtgagtggaatgtagactagatttcagctcccctacaacccttcagctgaacattgtggtgcagtgaacagcctgaacatggagttaccagtagttcctggtgaccgtggctccagggaacctgatttgagaaccattttttttttttaaagattttatttattgggacagccagggtggctgagcggtttagcgctgccttcagcccagggcgtgatcctggagtcctgcaattgagtcccacgtcagactccctgcatggagcctgcttctccctctgcctgtgtctctgtctctctctctctctgtgtctctcatgatttaataaataaaatttttttaaaaaaattatttatttatttgagagagagaatgaatgagcaagagagagagcagagcacaagctggaggaggggccgagggagaaggagtagctgactccccactgagcagggtgcccatgtgggacttgattccaggaccctgggatcatgatctgagtgaagatagatgcttaatcaactgagccccccaggcaccccgagaaccaatctttacctcctccctcatgttatggagttggatcttggggcccttagagggggccggggtgtccatgctcatcctgtgagtttgtggtagggcctgaatggccccaggtctctgacccaccttgggctcattgaacacacggacagtgcacaatggaagtgcctggtggttggtcatgggcctcctgggggcagtggctcagctgacatcctagatagccctctctagacagaccccagggccccggcccagtccccgggaagagaggaggagggtttggatggtcagcagctttgcagcctgttttctgaggccctccctcaggcctggtgccccaccccctgtcctgtagaccttgcttccctgtgtccccttctgtgatgaggtgggtgggaaatgggagagggtgggcctccccctagagctgtgagctgggctgaagagacggggcggtgggggggggctgcctgaggtctgttgtaaataccccgtctttcttcccgggctgggggctgtcacaggcttccttcctgctgccaacatgggccaagactgaactggggacctggcctgggtgtaagggcgcttacatgtgtgcacacacatggtcatatcgtcacacactgtaggttggtgggaagtcatgtggtatgtggctagtttccctaacagccaccctcatcccagtctcagccgtgaggcctggataatggggctgaggagaagatggggcagaggggccggtgctttcagggagtgccggtctgttggaggagacggagccctgtctccaggaaccccagtctgacagaggagatggagtcagtctatccttaggcagcttccagtcagatgtgacagaagtgcttagaaaaaggtccttaatgggaagccacccaaatcctcaaggccactagagttggatctgccagagtgggatatggcccaccagtgagggcttcctggaggcagtggccaggagcacatagagttttgggagggagtgtcttagaggagaggggtggaggaggaggaggaagtagcaccaggcacatctgtcagggtttggactgtggcaggggttctgtgttgggagcatcaggagtctgctaagatgggggtagtgaggcacagcttaggttgtctgctggcggtatcagagggcatagggagcccaagggcctgctggcatgccccctccagagaaggtgaggaggaaggggcaggggattgggattcagttccctgggcctcatgctatccgacctccgactgaccctccataccctgactatcagaccctatcaacagagggagggaataggctaggtagcccctgggtgggtgggagggtcactctgagtccagcgccaggagctctatgtgtttgtgagcatgcccatgtgtacatgtgtgggggtaggggatgtcaccctgcaggagcaggcttctgagcctgccttccacttctgtgcatgtctatgcagcatgcagcccagatggagcagaaacagaatgacacagagaacaagaaggtgcatggggatgttgtgaagtatggcagtgtaatccaggtgagacccagttgcatctccccctgaagagactgggctggtgttgggtgggggtgccagcagcatgccctctgggggttgcatccccagtgggtggccctgggactgtctctgtgactgcatatctgctctgtgtgcacctcttgctgtgtggcccaagtagctgtgcccatgggcatgtttctggcacactggttaccagcacagattctggagtctgagttcaaatcttggctctgtgaccttggttgggcaaattgcttaacttcctagtgcctctgtttccccatctgtaaaatcaggccagtggtagtacttcccttttgattgttgtaagattatacgaattaatacagagaaaggattagaaanccttcacctgtcccgcctgtccccctatgtggttgtgggggacaaggtgatcctgaatcctgtcaacgccgggcagcctctgcatgccagcaattatgagctcagtgacaacgtgggctgcaaggaggtgagtgggttagtggggtccctgagggcctagacagcccctcctcactgcagtctcatcccccagccccccagcccccatcccccactgcctgctgcatgaactgcttctctccattcctctgcctgtttctccacctctgccctattctgcaccctccgggctggcagccccagggcagccgggtggggcctggggggccctggctgagagcagacacctcttcctggtgccctcatgggaaatgggctgctcttcccctcacctggggcctttcacttgccccagtctccaaccgctgggggtcagccttgcatctaggttcactctgcccttccccaggtcaactccgtgaactgtaacaccagttggaagatcaacctgttcatgcagttccgagaccacctggaggaggtgttgaaaggggtaaggactgggggcccccactgctgtcacctgcctgctggctgcccagcccctcccctgcaggtcccccttctcaccttccctccgcctccccatacccagctctgctcctcctctggccctcccctccatgcgcctctgtctctggctctgcaccctcttcagccaccgtccacccccatggcaccccagacccccctccataagttggacaaccccttctcttgtctctaaccttgcttcctccctctccatcccttcggggtcctggctagcctcagttttgtctcttgctaagggtgtgccagtggactaggggtccccatccattcaccatgggggcctgcatcctttgacctctccagctcccccacccccatgcctgttccatggatccaggcccggcgccctgccctttgccctgtgccctcttaggcaagggtctgaggctggtgagtcagggcctgtgccctggttccagacctgctagcttgcgtgctgggacataggggttggcagatacagaggggttcagcctgtgaggcagggtactgctgggtagtgtggtaatgacttatggagggagcagagtgatggggaaggagggctggagaggccagtagaaaagccctgaaaacccgatgtggtgatgtggcgatgtggtggagagaggggggctcagaggtttaggtgggctttagggcatcgaactagcctactggagtggaggtcctatgcagaggggcagatgggaggggcagatctgggggtagcagagggtgaggctcctcagctaggggaattggcaggcacctggccgtgaaagggacacatagtgacaggtgacaggcctgagagcagccacccgaggaggctggctgctctgtgttcattgcatcctctcctgcttagaagcctgccctggctccctttaccctctgctcccagccaggctgttgtgtcagactttactgcccccatcaggctactgtgtcctatcacccgcccccctccatctcctgtccaccatgctctgtccaagtacctttctttccctcccttaagcctgcataccatccacataccaatcaagcctcagtctgtgtgctacctcctcccagaagccttctctgattacacattcccgtcccaaatctgtgtggcacttagataataaagcagggtgctgcctggactggtttcggtgaatctaactagtgcccctagctatgtgacctagacaggacacttacctgctctgcctgagtttctccgcccgtaaagtggggataatgatatatgcagccggggagtttgtgtgagggtcaagtgagaaagtccatgtaaggtactcacaccgcagctggcacgtgggcagcatacagtgtcacttcattaaaccatgaattctggggagcctgggtggctcagcagtttagtgaagcctttagcccagggcctggtcctggaaacctggaatcgagtcccacgtcgggctccctgcatggagcctgcttttccctctgcctgtctctctctctgtctctcatgaataaataaataaaatcttaaaaaaaaaaagtacacagaagtgatggtcgcaccgcatcttgagtgtaccactaaaaaaaacccaaccaaccaaccaaacaaaaaaactgtgaattctaatttctaatcctcgcagtgtctgcaaggaggccatagtatccccattttacacaagaggaaactgaggctcacagatgttaaggggcttatccaaggttacacagcttgtgaagcagaaccaggatccatgcttggtctctgtgtccaaagccctggagatgaataggccacagtttttgccctccagttgtcccagtcctgtgggagcagaagaaatgggcaagaactacctatattcaggcagaaggggccccagggaggtacagccatgggcctggggggacccccgcggggtgatatctctcctgccttcatagagtgggtttctagaggtacccttcagggaagaagatgatcaagggtgggtttgaccgaggaagccgaggaaggctttggataagaccatgtgatctggaggttctggatgtgggatctgggcagagtgcctctggccctggccaccctccagtggggcttagcatgcatctcaccccctgcatctgaggtgggggtgctgggcctggcccccgggaaggtcctggccccttctgagcccgtgacccacacctgcagggtgatgtggtgcgcctgttccacgcggagcaggagaagttcctgacgtgtgatgagtacaagggcaagctgcaggtgtttctgcgcaccacactgcgccagtctgccacctcggccaccagctccaatgccctctgggaggtggaggtcagaacttgtgccttaccccagacccaaccctcctctccagccctgggcccgccccttcttctcccatcaccctataggggagagggtgtgaagccagggagggatctgggtgccgctgacccagagctctccaggcctccctagagtgtgagccacccctccctggccagtgtctcctcccagcctcacccctgcaccccccaggtggtccaccacgacccctgccgcggaggagctggccattggaatggcctgtaccgcttcaagcacctggccacgggcaactacctggctgctgaggtgagtggggaggtagagggccccctgggagctcaggctgtatgcatgtgggcatgcatgagcatgcgggcctggtacacgtctgcacacgtagtcacacgtgtctctgtgacttatttgcactcttgcatttaacaaatactatcagataattgtgtgactgcaaataagcctaatcaatgttactgggcctctactacgtgccaggagctgttctcggcactgggggtaccacagtgagccagattcccagtgctcgtataacttacattccatatgtatgtctgtccaccacacaggcttgtgtatactggggcattcgtgcgtattggggcgtgtgtgtgtgtgtgtgtgtgtgtgtgtactcatctgtggaaccatgaacagaggcatgaagggcagggtctgggggctcttattggtggcttcttcaggagtgacttgggttttagtgctggggtgggcacccctgggacggtggaggctctctgccccagcgtagggctctgtgtggaccttgttttgggatgggggtcatgtgagcatagctcagtgtccaatagctgccccaccttgtgtctccatccaggagaaccccagctacaagggggatgtctgtgaacccaaggcagcaggaatggtgaggaccagggcctgggaagagggaccatgggggctggccatgaaaccctgggaggtgagctggagggggaaggactctcaggtgggaccccaggtggtttcgtggggcccaagagcaaggaggggcttctgagctgggatgctcatgccagggtgctcagggtcgtataggtcgccggaatgctggggagaagatcaagtaccgcctggtggctgtgccccatggcaacgacattgcctccctctttgagctggaccccaccacattgcagaaaactgattcctttgtgccccggtgagtaagtgccatgtgccccaagggctgacgggggtgcccaggctgtgctgtcctgtcccttgtctccctgcatcctacctcctctgtgctcctgacgtcctctggcctcaggacctgcgtgtcctgtccctctggggtccgagctttcagagctggggacagctgaccaccacgaacactcactgtgtgcctgaccctgggttcagtgcatgctgggtgctgccttgtgccagctgctttgtcaaaatgccttctctccagagttcttatcagccacctgcccccattggtctgcatattcaagcataggctgcaccagtttgtccacggtgcactgttgaggggtgcaggctccctgatctttcaggcccttcccaaccctgaaacgctaggacatagcatcaacaaacttcctggctgtcactcaagctttagcatttaccagctgtctgacctcgggcagcttacccaatcactttgccctgacttcccgctctgtcaagtgagcatatggagtccaccctagacagggctgctgggagaagtgacagagtcaccgttaggcccacccacccttacctgaaaatcctggggccaggtgcatgttgagattcagattcagattgttttctatttcagaaaggtaattacatttcataataagagacaagagtgtttctgctctgagatgtgtggatctcaacactaagtgggataaatagtctaaatagtctcatttgtctaaatgaatcttggtttcaagtttacaaacaagctcaggcttttgggatgctctgggtttgggagtggaggtgagacgcttgcctgggggctgtttgctggcccctctgctctggcctgggctcctcccgcccatggctgtgaagtcaggggggatgtggggccgtccttgggtagagcagaccctggctgggatatgatccaagacatgccccctgtgtcctgccccggccccgcctgcaggaactcctatgtccggctgcggcatctctgcaccaacacatggatccagagcaccaacgtgcccatcgacattgaggaggagcggcccattcggctcatggtgcgggccgcccagggctgggggggccggggctgggcccttggtttgttcctgggtgccctgctgacctctgtccccgcagctgggcacctgcccgaccaaggaggacaaggaggcctttgccatcgtgtctgttcctgtatccgagatccgagacctggactttgccaacgatgccagctccatgctggccagtgccgtggagaagctcaacgagggcttcatcagccagaatgatcgcaggtgggccgctgggcggggtcctcgaagggtctgtgtttcatgaacaaagaagatgctgggcaggcttggttggctgggatgggggagatagatgtgggccccaggcccttgccttattgcttatgtactcccagaactcaccctgatgttgtgttgatgctcagagagattaagagatttgtccatggtcacatagctagtaagtggcagggtcaggatggaaatgcagagtcacaccaaaccccacccggtgccctgttgctcctttctagaatggagtatactgagattcattgtcttgggcactttggaatccagcgggtgggggctgggggggcggtgcgagggatgtattgagagccttttggggtgaagccaggaagagaagttgaaggctgatgatgggctctgtgctttggatagccgggtgggcgggtgactcaatgagagcatgtttggggaagggctggttgcccatgattggcacttgacaggtgggtccccggggggtgtttcccagaatcagtgcctcacgcttgtcatctctggtgtcccttcatgaaggtttgtcatccaactgctggaggacctggtgttctttgtcagcgacgtccccaacaatgggcagaacgtgctggacatcatggttaccaagcccaaccgagagcggcagaagctgatgagggagcagaacatcctcaaacaggtgcctgtgtgcacgtgtgggggatggggtgggctgcatctgggccctgcagctccaggtcttgggggggggttgtccagaacaggagccttgtcccatctgccgtggacctgcagtctcactgcagcttctcttcacccctttgtagaaaattagtatctgttgcacactgatcacatgccaggcactgccctaagtgccctatgtgtcctggctcagttgatcctctccacttgggggaggtacagtaattatctccatgttacctgtaaggaggtgaaggcacagagattggagtaacttggccaagagtatgaggctaggaagcagcaggatcaggatttgaactcaggatgtttcgtccagaacttgtgcttttttcttttttttttaaagtaagctctatgcccaatgtggggtttgaactcaccacctggagatcaagagtcacatgctcaacagactgatccagccaggtgtcctcagaacttgtgcttttaaaaaaaataggggccccctaggtggttcagttggttaagtgtctacttttagctcaggtcatgatctcagggtcctggggttgagtcccacattgggcttcctgctcaggggggagcctacctctccctctttctctgcccctcccctctgtttgtgcacttacttttaaataaaattaaaaacatttttttttctggggtgcctggctggctgagcccgttggtggcatgtgactcttgatcttggggtcatgggttcaagccccatgctgggtgtggagattacttaaaaaaatattttttctgggcagcccgggtgctcagtggtttagcgccgccttcagcccagggcctgatcctggaggcctgggatccagtcccatgtcaggctccctgcagggagcctgctcctccctctgcctatgtctctgcctctctctctctctctcatgaataaataaataaaatctttatttttttatttttattatttttttaaataaataaaatcttaaaaaatttttttctaagttttgattgtgaaacttttcaaatattgagaaagtagtgaaagaatagtatagggaacactgtacaaccgctgcctggatccacctgttatcattttgccattttggctttatgtaactgtacatgtgtacatctgcccttccaccctggcatttccaaatggggtgtacctctcccctgagtttttcagtgtgcatctcctggaataagagcactgtcctccataaacgtaatactgttatcaaatgtaaaaaattagtaataatactgatctgatgatctgtaccatatttctctcctttacccaaaatgtctttttaaagcttgttttctttttttttttttttttttttttttttttgggtgcctgggtggctcactcagttgagcatctgccatgggctcgggtcatgatcctatggtcctgggatctggccccgtgttgggctccttgctcagcgggagcctgcttctccctgtcttccccacttgtgctctctgtagctatctctgtctctcactctcaaataaataaaatcttaaaaaaaaaaaaaaagaaaaaaagcctgttttttgagccaggatctcattaaggttttctcattccatttggttgcatttctttggtttctgttttagaacagtttttcatgctcacccaatccatgcttttaaaatttattaactacatcaacattttttttttgatgaggcaggcttgtgtctgggctctttggtgctggccacactgacctggcctgccttttctcttagcctcagacccctgagctgtggtagccccagatgctgagccaggcccaggatctgagtggagattagtcatgtggggatgagtgggctgaggccagcgttgggatatcggccaggagaagggagtgggggctggaagtggggccgatggtgggtgggctggggtctcactccagattagaatcagcttggtcattcatgtccgtatggccttggggcagggtgagtttggggccgaggattcctgggaaaatgaggggtgtaggggatccctccttattctctctgctcccccagatctttggcattctgaaggcccctttccgcgacaagggtggtgagggccccctggtgcgactggaggagctgtcagaccagaagaacgctccctaccagcacatgttccgcctctgctaccgtgtgctgcggcattcccaggaggattaccgcaagaaccaggtgcgctggggcgccaggtggctcagttggttgagggtctggctcttgatttcgactcaggccgtgaatgtcaggctccacttaaagttctccctctccctctgctcctcccccgccacaccatttctctctttaaaaaaaaaaagaagaagaagaagaagaagaagaagaaccaggtgctaggctcaccctggcctgaccctccctggcctgggcagccccactcccttgctcactgccttgctcactccctccctcctgcttttgttcattcagcaaacattttctgaggcatacacctgctgtgtgccaggcactgtttcaggaccccagggatgcagcagggaaccagacaggagcatcagcttcatgggtgtgcaatccagctccgtgctcagaagggcctcaagatgggtttgccatcttgaaagtctcagtttttgaagaagggtctggctgtttaattttgcacagggacgcacaaatcatgtagccagtcctgccagccaatttcctccctcatggaggcctccctctggtcaggagacaggctgtgagctgaagaactatgttatgtgaacccactcttctgcccagtgcttgtttcttctcccagacctccacctgactagggttggggttccctgcctggggtagtgggctagagcagagccgccccccctccactcagctcgtctggtctccaggagcacattgccaagcagtttgggatgatgcagtcccagatcggctatgacatcctggccgaagacaccatcactgctctcctgcacaacaaccgcaagctcctagagaagcacatcaccaagacggaggtggagaccttcgtcagcctcgtgcggaagaaccgggagcccaggtgagcccacctgttccctgactgcgcccactcccttcttcccggtcctcccagggcacagaggcagttggtgctggtcgttaaaatagtgaaaaaccatggcctccatgggtaaattgtccacgtgtctgagatcctggcctctgcagccccttccttggacccctcccaaatttgacccaatcttggaacaagagagttgacacccgatacaggagaagacctaagacccttctctggtgacgaaattggtgtctgtatttagccagttgttaaatattttgaatatccctcctgtccttgtgccccctttaccctggcccccgggatccccagctggcttccccctgcccagggtgatcagggtgatgcccatgacttgtccctccccaggcagcttggagtccatcacgcccatctcccaagctttggggcaggaacagaagcaagtaaattagctccagggagcctgtgctgcccgtggggacaggaggaggagggtgggcttcatccccactggggacaggctcctgagtcccctcgcacccctgctgtcaccacgccaggttcctggactacctctctgacctatgtgtgtccaaccacatcgccatcgccgtcacccaggagctcatctgcaagtgtgtgctggaccctaagaacagcgacattctcatccagaccgagtgagccgctgccttgccctgcttgggccctgtgcatgtctgggctagaactggccctgggctctctggatgtgtacccttgcctgctgcgtgcccagctctgtgcccaaccccctgtgaagcctgccttctggcctctgctggaccagagggggcccctgtgaggaaggggccttggggaatgagccaaatcctctgtcctggagaagctcactgtctaagaagtgtgtttgagctggcacttggccgagctccaggcagggtctttgtggctgggcatgctcggggagggctctgggcagggggtcctcctgtgatgggtggccctggtttgcaggttgcggccagtgaaggagatggcccagtcccacgagtatttgagcatcgagtactcagaggaggaggtgtggctcacttggacggacaagaataacgagcaccacgagaagagtgtgaggcagttggctcaggaggcgcgggctggcaatgcccacgacgaaaacgtgctcagctactacaggtgcctgtgggcccagctattgcctgtccttcagcgctccccatgcccttgggccttctcagaaggctgtcagccaacccctgctgagggatgagctcaagcagctttgtggccttcaccgtggagactgagggaaggatgactgtgtaaccctgagagctcagcccagtgacagggcctgaaagcaccccagacctgtccccaaacatatttatttaaaaaataatattagggcagcttgggtggcgcagcggtttagcgccgccttcagcccagggtgtgatcctggagaccagggatcgaatcccacgtcgggctccctgcatggagcctgcttctccctctgcctgtgtctctgcctctctctctctctctgtgtgtgtgtgtctcatgaataaatatataaaatattaaaaaaataataataaaaaaaattagtggataacacttagcaaatgctggccatatcccaggccactcagggaaggctcactgtagccctgtgactattagcaccctcaaagttagggagacaggcacagagaggtgaaagagcttgccagagctcacacttccttagtggtgggccacagtacaaatctggcgtcagggccgcagtgagtgaggcagggctctgagccagaagctgagggcaggccagcacccagtgcagagcagcaccacctgagagcctaccttcagcccctcttctgctcggagctcacccctgtacctgctgccctgccgaggcccgtccccctgctgcacttccctcccctgcagctcccagcctctctgctcagccagctctcctcccatgatgacctgttctggttgagccagaaagtgccctcctccttctcgaggaggggaaagctgcaaatcctcactcagaattgtgtctttcctgttgtgttggcgggtgcccggtttgccctaaatcccttggtcaccttcccaaggcctcaggtagtactggtagccctcctaggccctcacctgtcgtgtgctcaccctgtgccccctccccccaccgcaggtaccagctgaagctctttgcccgcatgtgcctggaccgccagtacctggccatcgatgagatctcccagcagctgggtgttgacctgatcttcctgtgcatggcagacgagatgctgccctttgacctacgcgcctccttctgccacctgatgctgcacgtgcatgtggacagggacccccaagaactggtcacgccggtcaagttcgcccgcctctggactgagatccccacagccatcaccatcaaggagtgagatggggaggggagggcgggccaggcgaggccagggttggggggcgtctctgtgaccctcatgcctcactgcctcacccccagctatgattccaacctaaatgcctctcgcgatgacaagaagaacaagtttgccagcaccatggacttcgtggaggactacctcaacaacgtggtcagcgaagccgtgccctttgccaatgaggagaagaacaagctcaccttcgaggtttctggccaaggggggtgcaagggggcctctggtttgccccctcactaggagtcagctgtccccaggggtgtccccggggttccatgacctccattccctctatgccccagccacttcagggagacggcacagactgctggggctccccgggtaaccttccttgtggtcctcggtccttgctgcctcatcagcccaccgtgggtggctgcatccttgcagccctgtgctcccccggaggtcctgccttttcggaggaacttcatcacctcctgacacctgctgggccccactttccggtccagtcccgccctgcccctcacttcggccccgccccctcccgcaggtggtcagcctagcgcacaatctcatctacttcggcttctacagcttcagtgagctgctgcggctcacccgcacgctgctgggcatcatcgactgtgtgcagggccccccggccatgctgcaggcctacgatgactcgggcggtgaggctttgtggccagggtcacccccagccctggccttcctccatcttctcctagtgccaaagtcccttctgatcagccccctgagcagcctgccttctggcctctcctggaccagatgggcccctctctaggctctgtggagaccccgaggtctgggggagtcgccttccaacgcggcttggtcttgaggggagatgatgggggaagatgggagacacaggccctgcctgaggggctcccagtcatacaggggaggtgggggaaatagccctgccacggaggaatcaccgtctgacagcagccacggccctgccctcagggacatccctagggggcataaaccctaatcaaaatgtgcacagagtctgacacctggtgtgtcatgctctgcacatggtgtcccctgggctgtgcatgctctgtagcagcccttagggtgccctgcatgagggttctcactggtttccccacacaatgtacctttgccctggccagtccttctttactcagatttggcttgaagctcacctcccccaggaagcctttctgggttagccctgcagctgacagagacagagtaaggccgcagggccctgctgtgcaccccctgtgatcccctcatgcttctccacaggcaagaacgtgcggcggtccatccagggcgtgggccacatgatgtccaccatggtgctgagccgaaagcaatctgtctttggtgcccccagcctgtctgggggcactggtgccacggagccactggacagaagcaagttcgagaacaatgaagatattgtggtgatggagaccaagctgaagatcctggagatcttgcaggtagctgggcaaggacagtagttggaggtgttgggaacagggcaggagactgggtcccgggacaaggaggttgtggggagctgaaccccagctcagatcacagtatcaagtactgtagggctccatagtgattggttgtgtagcccaatggttttcaaagtatggtccttggggtgcctgggtggctcagtgggttgggtgtccaccttcagctcaggtcatgggtcatgatcccagaagcccaggattgagccctaagttgggctccctgctcagtcgggagcctgctcctccctccacctctcaccttgctcatgctcggtctctctctctctctctcaaataaataaataaaatctttaaacaaaacaaaacaaattgtggtccttggaccaacagcagcagcagcctcaccagggaactcagaaatgcatattcttgggtcctgccccagacctacatgcagaacagaagcacctgaggaggcccacagttgtgctgtgacaagcctcccaggtgatggctggtgcgctctagagcctagctccgtccctccactgtacacctgaggaaaggaaaagcagggactttactgccagtggccagagattttgaagcaaagctagagctttgagagcccgtttcctggtgaggcagacagtttttcctgttctgggtcttgtttgagaacccccccaacacttggggaaggggcttgtagggtccccaggactggtaaggatgcttgcgtttgccttgctgccaccagaggacgggaagggtagtgcagtgatctccttggggacccaggctggccaggggcctgggcaggggagtcagaggatgtgattcattctaggagctaagggcttccagatctgcatcctggggtgtggtcagaagctctgtggcccataaggatagaggccagtcaagggtgtctgcaaaccatctgtccccaaccccctgccccacactggcatctcctgcaaccccctccccgggtcttcagttccaagccccctgccgtccagccccaggcagagcagggtaggaggatgaggttggcctctgggtccggggagcttcattctcattcccgtcactgtcctccctgcgcaggagggacagagtggtctctgcctcatttggagaggcgctgtcatcgtccctcagcactgaggcaggagcgggggagagggtgctctggacctccccagggagaagagtctggattttcttagcttctgatgctctgcagtatctggaacatcagtgccgagatccctgtgcttgagctcattctgggtccccctcccccgtcctggggcacaattggcctccccacctcagccccgtcctcactcccatcctcctcacgtctccagttcatcctcaacgtccgcctggactaccgcatctcctacctgctgtccgtcttcaagaaggagtttgtggaagtgtttcccatgcaggacagcggggctgatggcacggccccggccttcgactccaccagtgagcaccccccgcctccccccaccttccaccttcaggctgaggcttcatgactcacccaggggtgcacattagtggggtggaggctgggagatgcctcgaggccagctccccagccctgcctgtttcccagatcatccaactgtcgcggcaaggggcaagggcagacatcattctctccatctcctaaatggagaaacagaggcccagagaggggcggggacttgcccagggtcacagcctgtcagaggctgaaccaggccaggacccaggtctcctggggcccagcttgaaactatgctcaggcccctgccctggctggctcacccccaccgaggagcatgcaagtggggtacagggattggggtggtttggggtcctccctgttccctcagctgtgtgctccccatctttcctgggcacggacctgccacctgccctcatctacccacttgctccccgcagctgccaacatgaacctggaccgcatcggggagcaggcggaggccatgttcggagtggggtgaggccgggggggtggtggggctggtgggtggtgccagcacgggtgtgagaaccccctcttgggtctccaaggctggggctggccgctcctcccaccccctgcagccccttggctgtgtgcttttgctctctcgtgcctacttggccccagggacgtgggggccactggggccctaatgtcatcttggtcattccactgccctcaccaggcccgtcatggctgtgtgggcattgggcccagggccaggagccggagggggcggggggggggcggggacgaagggaggaagatagggcctgtaggcagggctgcgatggggaggggtcgccccggggggttgggcgctcttaaccacttctctgctgcccttggaacctagtgaagctcttggaccctgctcggaatggcatttataaattcacaaaataaagtgcatgaattacaaaggaaaccaagagctttgagatgcagttatcaaaatattgaagaaaacaaatttgaagtgacagatatttggctctttattaacacattaagcaacgagctgtgccgggggtataattaggagcatgatttcgaagtagtgatgaatgtaaacggtattcacaattcctgtaacaactgtaaggtggtgtgagaacatctatgatttttctcggtgacaaaatcatacgtactgctaatttcctctcgctggaggcaacactgccttttggaggcaggtcaacccagagatgtgactttccccaccccgttcctggccctcagcccatccccacgaacctctgttgggggtgagtgtgggtctccccacagggagcagctgcttgagctgcttcatccaggggagccctgcggggtctcagcggatgtggggatccctcggggctggtggctctgcacacactgggcagaaatcactgtcctgagcgagtgtgacactgggcgctgcatgtgcaaaggggtgtggggagctcgtgtgcccaccgtgcccctcgtccggcatcacaggaagaccagcagcatgctggaggtggacgacgagggcggccgcacgttcctgcgtgtgctcatccacctcaccatgcacgactatgcgccgctcgtctcgggggccctgcagctgctcttcaaacacttcagccagcgccaggaggccatgcacactttcaagcaggtgccgctcccatctgagcccctgggcctggggggcttgcgagtggtggtggggtgccccagccctgctctggctggtgctgggcgctcaggcttgaccaccgcagaggagctcacaggtcaggggagctcaagatatttctttcgtgttctcggtcttgctgaggtccttaaagagaaaggcccgcggttggccacctttatgacctcttggcctgacgtaaggcctgtcactttttttatgaggtggacagcactttagagtttacaaaccgtaccacatgcgcctttgttgggtgcttcaagtcattcctggcacgcagtcagctctcgctaaggtggttggctctgtgactgctgtgtcgtgtggtcttgacagcttccccccacccccccccccggaaattccaccagcaggtgccaggcaccatgcagcagcccctggcaacgtggttacgactctcattcctgttttatggagggggcgtggaggcccaggaagctttcctccctcaccctgaccagggcgagtgaagtgggagccgaggttcacgtacctcctgtagccggcattcagtgatgccagtgtgcttgattctgccctgttcggggtcgaagtgaccaagtgacaggccttagtggcacaagtcagtgagtaactgaagccagggggcggggcggcttgagatgaggaatacagggaagcctccagccatcagggaaggcttcttggaggcagtggaccatggcggagccatcagccctgggtaggagcagaagtggaatggagatgccgggagtggaggcctggaacagggcaggtccccgagtatggggggtggtctctacaaggtggtggagccggggtgcccgtccaacctggcacgccctccatcaaccttcaggtccagctgctgatctcggctcaggatgtggagaactacaaggtgatcaaatcggagctggaccggctgcggaccatggtggaaaagtcggagctgtgggtggacaagaagggcagcggcaagggcgaggaggtggacacaggtgcagccaaagacaagaaggaggtgagcggggcgacagggagctggaagtccagggctcccggcgaggctgggcctggctaactgcccctgccccctccccggccccattccctgtgtccccagcggcccacggacgaggagggctttctgcacccacctggggagaagagcagcgagaactaccagatcgtcaagggcgtgagtattctggggccctgaggtcccccggaggccccagagccgggcctttcctgcctccctactccgccggccgctggccctcaaagtacacatcttctggctttgcatgtgccttaaagacaaccctgccaaggtccagatggaagtattttaaagctaaaggaatttaatgaaattccatttcacagtcatattgttctatttacttttatgggcagaattgggtttttagtgctcccctgccttgttgcggtgatctgactcagtgaccgtggcctccttcccccttcctgtccctgatgtggcctggggcttggctgggccggcagggggctctgaccagcctgagcaggggggccagggcggagggaaggcgctccaggctcaccgccccacccttgccagatcctggagcggctgaacaagatgtgcggcgtcggggagcagatgaggaagaagcagcagaggctgctcaagaacatggatgcccacaaggtcatgctggacctgctgcagatcccctatgacaaggtgacctctgacctctggctccctggggcagctccccgccaggccctgaccacacagtaaccccgaatgttgacctagccccgcctcaccccaatccttgaccctgaccccagtaagtttccctctctggctacatcctgaccatctctgcttccctgtgacctctgactgttgtctctgcatcttgagccatgttgatcctaatccgatcccagcctgtctgtgactcatgaggtcagctcctcataatgactgctgctgatgatttcataccctagcctcgctctgatctctcaccctgacctgtctcccacacaccctggccccagactccaaattcagcatcatttcaccttttgactttccatgcctcaccttgactgaccttgatcctgatgtgtgccaagcctctcactggctcttgagccctacacccagggttcacctgaccctgaccctgacccctcagccttgctcccccatgccagcctcacctcagcctctgacccttagcccctcacacatttccttatcctgacctggaggcccagctttcaccttaagcccggcctccctgtggtcccagtcccaagccctgacctgctgccacacttgttggaccttaggcccaaggcccggcctcactccccctcctctcccggtacccagggagatgccaagatgatggagatcctgcgctacacacaccagtttctgcagaagttctgtgcggggaaccccggcaaccaggccctgctgcataagcacctgcacctcttcctcacgccgggagtaagggcacaaggtgggaggagctgcggggggaggcaggacctggatccccctttctcatgactgcccacctgcccacagctcctggaggcggagaccatgcagcacatcttccttaacaactatcagctgtgctcggaaatcagcgagcccgtgttgcagcactttgtgcatctgctggccacccacgggcggcacgttcagtacctggacttcctgcacactgtcatcaaggccgagggcaagtacgtcaagaagtgccaggacatgatcatgaccgaggtgaggacgaggccaaggggcgcaggggagctccactggtggctgcagacagggaactcaggaggcaggatccaaagttaagacaagtcagatagcgagtcacagaagggacactgaaggcattagccccaggggagggagaacttaggtcacaggggcaggtctaggaggactcagacggcaggcctgaaggcacccaaacactcctctctttatccttttattatcacgtatttaaaaattgttaaagcagctgctgtatgccaagggccatgtgtacctgggggatgtcaggggggcaccatccttcatgctctctgtatgggcccagcatctggaggagggggcacttcatctgggtccaggttcagccctgatggtagagggcctgaggcatcagcccacagccctgggggccatgcaggggaaggtgttcctgagtagtcaggtgagggccggggtcagagtcccaatctctccctggagcctggggcctgcctgctggactggggaggcgggggggtctgacggggcacccttcctgcctgcagctgaccaacgcaggtgacgacgtggtcgtgttctacaatgacaaggcctcactggcccacctgctggacatgatgaaggctgcccgggacggcgtggaggaccacagcccactcatgtaccacatctccctggtggacctgctggccgcctgcgctgagggcaagaacgtctacactgagatcaagtgcacctctctgctgcccctggaggatgtggtgtctgtggtgacgcatgaggactgcatcacggaggtcttctggggactgggagaggtggtccgtgggggagtggaggagggccagggtagaggcggcggagggcagtggtagagccaggcgggggcagcctctcagtcctgggatgtaaggagcatggggtgatgggaggggcatggccagaggaccaagcggggaggtcaggggagaattgatagggtgcagaggagagcctgggcaggtgccccccctagcgcccctgacctggctcctggctgctcaggtgaaaatggcctacgtgaactttgtgaatcattgctacgtggacacagaggtggagatgaaggagatctacaccagcaatcacatctggacactctttgagaacttcaccctggacatggctcgggtctgtccccggggggcggcgtgggcttgtgggcgcgccgtgctaggcagggtcatgggtgggagtccaggcagccttccagggggagtgagtggaggggcctgtctcctaccccaggtctgcagtaagcgggagaagcgcctggctgaccccaccctggagaagtacgtgctgacagtcgtgctggacaccatcaatgccttcttcagctctccattctctgagaacagcacctccctgcaggtgagcttctcccacccgcacaacttgtgtgcagggaaggggaaaaggagagtaaatactcatgtttgcttgtggcgcataaagacgtagcacaaggacacacatgtgtgtgttagttgtgtatgtgtaacaaattgcccccaaaattagcagctaaaaacaacatttattctcctataacttctgtaggtcaggaattacagtggggacagtaccctggaacaggaattcctaaattgacttcgcatgacgggccccagggtggcaggggagagctggcagcaccgcctcaccaaagagagggcggtcatgtctactgtgatggatagcagagcccgagcagtaatccagagggcccgatgcagagatctttggtgttggcttagttgatcgggtgccccaggcccgaaaagacagccttctgcagtctcacctgcatcagcagaaaggctcgaggctagggagcagaagtttgcctttggtcactgaagagtcatgtcccctcaattattctcggatccccagacttcatagcccagagccccttgaaggcaagagaggcaggttccctggaggagggagcctgcaaaacaaatcataaatcataacaccagaagtccccgcatggacacaagagacccacagaggggttaactacacacagagggcctgagggtggaatgggtcctcgtctgtccacaagggcgggttgtcttgacacacacgtctttggaccctgggacctcttcgggactatgaacgatttgtgtcagcttttcccacctctccgtcccgggcagaagtgggagaatgggctgatgggatcaaggccggggtgaggcttttcaaagtcatgcttttgtgttgcatactttcggttttgaaccatgggattatatcacctttttgcaatattgatttattttataaaaattttttaaaggaagtaaaggctcagcaataggtctataagccctaggtctggacctcagggagttctcacagggctgcacgtacggttgggcaggttgtgcacttccaagaggaaaaggggtgccttcttccaaccggcacagagacgtatggtagctattagaagccttcttcctccgtcatgcccactcccagtgggccctggtcacgggcctagggctgcccagggaagagggtgggcaggctgtagcagtggttgtgttgcctcttgcagacacaccagaccattgtggtgcagctgctgcagtccaccacacggctgctcgagtgtccgtggctgcagcagcagcacaagggctccgtggaggcctgcatccggaccctcgccatggtgggtgagtgtgccctggggactggctaagtccaacccctgcccctcccttcaccacagggacacctgccctccaaataaaactcggtactcctcagctcccccatcatctgctcccaggtagttctcagtaagtccttcttggcatcttagcaattgacagaagctttatctcctttgagctttgagtcagttccctggaggacaatgctgtgtgacatcccccagccaaggtctcttgcatgcttgtggatggtttcaggcagaagggaggccggcagattgctggggaacactggggaaggggactgagaggtgggagacaggagggatgggtcagggtggagcagggtagaatcaaagaggcagacactccctccttttgcctggaaaggggaagagggcacttcaggccaagtgggggccagcatgtccccgagtctcagttagttctccctgcccccagcacggcagccctggcccctctggctggccaagcctgcaccccgagtgccctccagcgcccccgtctctctccccagccaaaggccgggccatctccctgcctatggacctggacgcacacatcagctcgctgctcagcagcagtgccagctgtgtagccgctgcccagcgcaacgcgtccaactacaaggcggccactcgggccttcccccgcgtcacacccactgccaaccagtgggactacaagaatatcatcgagaagctgcaggtggctgtggggcttggccctgggcacgggaccgtggggcatcgttaaggggaagccaggagaacccaggcatcccctagtagggtgggtgctcgtaaagggggtcaggacacctctcagtcctgagaacacttcgtgtttatgcaacacattccagtccacggtctacacacttcttactatccacagcaggaggccgagactcagagaggacgaggggtttgccccaggtcacacagccagaggaggggttgggagaaaagcctgggtgggtggctcccagtcaggggctctgagcccgcagacaacctgcactgttcagggtggttctgtgggtgagggcccctcacacaggctgggagcaatcgcagggctgtttggcgtgggggcaggagcaatgatatggagaaatggcctcactcctctcttgggcctgggtggcctgcacctggcccagtagtgacagagccgtgccttgcccaggacatcatcacggccctggaggagcggctgcggcccctggtccaggctgagctgtctgtgctggtggacgtcctgcactggcctgagctgctcttcctggagggcagtgaggcctaccagcgctgcgagagtgggggcttcctgtccaagtgagcgagatgccgagccgggcacgggggtgggagcggcaggtgcaaggcagcctgggaaagggcaggaaggggcccgtggggaccgacagcccccgggcggagggccgtgtgcgctcctgccggggacggggcagggggagtggctgcagggaggcggctggggatgccccgagcgtgccccccttcctcacccgctaggctgatccagcataccaaggacctcatggagtcggaggagaagctgtgtgtcaaggtgctgcggaccctgcagcaaatgctgctcaagaaggccaagtacggggaccgggtgagtgccccggtgagctggacgtcatgagagcccggccagaagggccaaggactcagggccagctccggggctggtggttaaagggtgaaatgtgccagtgtggggcctcactcccttccccacagggcaatcagctgcgcaagatgctgctacagaactatctccagaaccgcaagtccagctctaggggggacctcccggaccccatgggcaccggtcagtactgcctccttgccactgggcctctgggtggccctcccttctgttcccctgcccctcgccccctcacgtgggttccccaactgcaggcctggaccaagactggtcggcgattgcggccacccagtgccggctggacaaggagggggccaccaagctggtatgtgacctgatcaccagcaccaagaatgagaagatcttccaggagagcattggcctggccatccgcctcctggatggtggcaacaccgagatccaggtgtggagcggctgggggtgctggggggctcaccccctgctcaggaggaggtacggtgtgccatgttgctgggaccgccggggcctggctgcagggccaggcgctgggggcctgcacggtctggctgtgcgtgggcgggtccacacacatcccccccgtgactgtccccgtgtcacgtggcctctttctacccacgcataccatcctgctgaagccaggcctgcgcctgtctccctagcacactgcccacatcacatccatcatccctgcctctcagcctctgctcaggcttccttgcctccccctctacatcctccttggcctctggtgcctaactgaaggactgcctcctctgaaaagtcccctaggattgctctagccccattcgttcattcaggccttggattttttgttttgttttgtttttaaagatttatttatttgagagtgagcaagggaggaggggcagagggagagggagagagaatcttaagcagattctgccaggcgtggagcccaacacggccctgagatcactatgtgagccgaaaccaagagtcggatgcttaactgactaagccacccgggcaccctccatgtgatgtttttttttttttttttaaattttatctatcatctatctatctaatctatctatctatctatctatctatctatcatctattttttattcatgagagacacacagagagagagagagagagaggcagagacacaggcagagggagaagcaggccccatgcagggagcccgaagtgggactcgatcctgggtctccaggatggtaccccgggctgaaggcagcgctaaaccactgagccacccaggctgcccccacgtgttgttttaataaggctatactcatgccttccaagtgcctgtcagtgttcaaggcactaaggattcagcagtgaacaagaaagacaaaatccatacatcctgtggattggtcctatatcctgggggggacactagccaataactacaatccctacacgatgcagagagtgtgttagacagtggtgaagggccaagggggtgctgggacaacaatcagggtggagcaggcagctggggccaagtttgaaggggaagtggctgatgtggcaggagaagggagagaaggggagagtggtgggccctggggtcagagaggtagcaggccttcagatggcctgtgggctgctgtgaggtgcggcttttcctgtgggtgagatggggcactgcagggtttcgggcaggggaaggacaagactcagacttccgaggggcacctgctgtgtggggagctgatggagggccaagggtacatgcagatggtgtgaggaggctggtgcaggcctccagcatcgctgtgatagcagtttgggacccttcccctccgcctctgccaatcccggccaccccagccccagcagtagtcctagagcctgtctggggacccatctgtggccccacctcatccctgcagcaagggatagagccctccagggactcaccaggggctgctcagagccaggcccagtgctgagagccaccctttccccagaaatccttctacaacctgatgatgactgacaagaagtcagagcgcttcttcaaagtgctgcacgaccgcatgaagcgggcccagcaggagaccaagtccacggtggctgtcaacatgaacgacctgggcagccagccgcgtgaagaccgggaaccggcaggccccaccaccaaaggtcagaggtcatggcggtacaggatgggggtgcccggccggggtcagagggtatagggtgcggtggtcacagggcaagaggtgcaggcaggcgcctgagggtgggaacatagggtgaacatagggtgagagtgaggtcctttccagcagcccagcctcaccaggctttgccctgcaggtcgcgtggcttccttctcaatgccaggctccccatcccgctattcactgggccccagcctgcgccggggccacgaggtgggtgagcgcgtacagagcaacgagatgggcatgtccgtgctcatcatgcagcccatcctgcgctttctgcagctgctttgtgagaatcacaaccgggacctgcaggtgagcacctgccccttccaccaccacgcctgccatctgccgcacacagggccgccatcccaggcctctccctccctgtgacggctgtgcccacccttttgtgccctgcagaacttcctgcgctctcagaacaacaagaccaactacaacctggtgtgtgagacactccagttcttagacatcatgtgcggcagcaccaccggcggcctggggctgctgggcctttacatcaatgaggacaatgtgggcctcgtcatccagaccctggagaccctcactgagtactgccagggcccctgccacgagaaccaggtgagccatcatggcagcgtggacgtgtgggtggatggagcaggcagggctggggagagactgagggctccggagctgccacagttctgagggtcccgggccccatgtacccccactgcctcctgccagacctgcatcgtgacacacgagtccaatggcatagacatcatcactgcgctgattctcaatgacatcagtcccctgtgcaagtaccgcatggatctggtgctgcagctcaaggtggggctcctggcagctcacacgagtgtgcatgtgacgtgggtgcatgtgttgagtgtgcatttggggtgtggtgatgtgtttaatgtgtacgtgttcataagcatacacgaatgagagtgtgagcaaacgtgttctgggtttatctgagggcctcctgtgtaggtgtctgctatctgggggactgtgtgcacccgcttcagggtgggggtgaaggcagccagcgggtgggctggcgttgcagggcacttctcagcaagtcctggggaacagtggggaatgcaaaggtggtgacacatcttgcgggccgggggaggctgttgtgaagtagacagaggaagggtttgtgggggtcactatgggggccctcagactgtggcctgccctcctccccacctgtccacaggacaatgcctccaagctgctcctggctctgatggagagccggcacgacagtgaaaacgcggagcgaatcctcatcagcctgcggccccaggagctggtgaggctgggccaggggtcaggtgggaaggcgggagttgggggaggtgcgggtgggctggggtgggtgggtgttaggtagttccctagccccaggaagacggcgttcaaccaggccctgtcccaccaggtggacgtcatcaagaaagcctacctgcaggaggacgagcgtgagaactcggaggtgagcccacgggaagtgggccacaacatctacatcctggcgctgcaggtaccggccccgccccgccccgccccgtgactcggccccgccccgtgactcggccccgccccgtgactcggccccgccctctcgcagctctctaggcacaacaagcagctgcagcacctgctgaagccggtgaagcgcatccaagaggaggaggccgagggcatctcttccatggtgggggcccgaggatgaggcaggatgtggggcagggcttagatctaggggcggggctgggcgagagattggagcggccggtatctgggggtgaggctagggattgagggcggcgatgggcgcccgtgggaatccgggatgaggcgggtcggcgccaggggctccgggcggagtgcggcggggacgtggcctgaagctgagtaaagagctagaattgggggggagagggcagggctgagggcgggaggagccggcccggtggcccttggtggccccgggtgaaacctggacggagtggaagcccagagcaggacagcggagggcgctgactgtcctgtggggttgtttggacatggctctccccctcccccctcttaatttggggcttcatcctcgttgggctgggctgggctgggtctggctgggctccggggccaggcctagcagtagggagttgccgcctgactcagcggcccctctacccccagctcagcctcaacaacaagcagctgtcccagatgctcaagtcctcggcgccagcacaggaggaggaggaggaccccctggcctattacgagaaccacacctcccagatagaggtgtgcctgagggcagcagggggctgtgagtgatggcggtgaacctggccctcggtggctgcggcctaggtgtgaccacgtgcctgtgtgcacccagattgtgcggcaggaccgcagcatggagcagatcgtgtttccggtgcctggcatctgtcagttcctgaccgaggagaccaagcaccggctcttcaccaccacggagcaggatgagcagggcagcaaagtgagcgacttcttcgaccagtcctcgttcctgcacaatgagatggaatggcagcgcaagctccgcagtgaggaccccagcagggcgggagggcaaggctgggcctggagctgctcagtgatgccccctgcagaacccccccctcacgtacccgtggttgtctcaccgcatgccacccctaggagggctccagccacgttttcctcctgcagtggggcctggaactcgtgcaggcaccaggggcctgcgtgcggtgggtggacagtgttgatcagagacccccactcacgccagcctgccaccaccctcctccctcaggcatgccactgatctactggttctcccgccgcatgaccctgtggggcagtatctccttcaacctggcagtttttatcaacatcatcattgccttcttctacccctacatggagggcgcgtccacaggtggggatgcaaggctggcagcccaccacgccccctccctgggtttgggcagagccatggggccgccaggctctgaggggaccagatgctgagtggggaagagcacccctgcactgctctttgggctctgcactccattgtggggagagagatgtggtctgtggcacaggcagggtccttgacctctggagacagtacatatctctctgtctctctctcacacaaacatgaggcagagctcagatatggtagcagcagctgggtagggcctcctgccttaaacctagacaggcaggtgtgatggtgggggccctattaccaggtgaccaagaacatactatgagggaaggtttccaggagggggtggcttcttggagtctgtgggggctggggctgtggtgggcttagctgaccagcgctcacccctgcccccttgccccaggtgtgctgggctccccactcatctcactgctgttctggattctcatctgcttctccattgtggccctgttcaccaagcgctacagcatccgccccctcatcgtggcactcatcctgcgctccatctactacctgggcattgggcccacactcaacatcctgggtgccctcaacgtgagtgcctgatgcctcccccatgctcatggtgctgttggccctcacgcaggccggccgcctcccagcagccactgctctgcccagccccccttgtccttgtgttgggatcaggcttgttaaaaatccaggggcaggactgatctgtgcctcctccatctccttagacaacctggggcaactggcacttggagccagtcagctaggggtcactttggggcaccagcttcagggctgccgtgtacatggtgtctgctgggcactattcacactgtagacatcaaagatgtgtatgttctgacaattcctgacagctggaaataaaaagtacctggagcaagggtgggcggtggggcaggcgccttttcctaacttaccaagtcaccataaaggccaaggttgatttatccgattctatcctccttcacctatatctcactttcttcctggagccaggggccccaggggcttctcccctattctatcccaggagcccagatacatttccagaagcagtctcattaatgccaggcctgccagtgtgagcaggaccagctcagatctgctccacagaaggggcaccgctgcagagagtggacatctggggtgggtggtgggacactgatccccatgccttatacttgccctcagctgaccaacaagatcgtctttgtggtgagctttgtgggcaaccgcggcacgttcatccgaggctataaggccatggtcatggacgtggagttcctctaccacgtgggctacatcctgacgagtgtcctgggcctctttgtccatgagctcttctacagcatcctggtgagtctgctgggggtggggctggcaggggcgtgtgcccctcagcttgctagcggttcccccacactggtctttctgtccagtcctcttgctgcggggctggaaggcatggacttccagagtcctcctctgcctgaccccagcctggccttcagagccctgatggccactcctgactcccatctggcccagctcccgaggagctggactgcccaggtttgtttcccagctcggccactctcagctctgtaattttgggcaagtttcttaattgccctacacctccttttctgtctctgtaaatcacagataattaacagcacctattttctagaatggtcatgaggctgaaatgagctaatgcattaaaactctacagagtatgtcctggcagatggcaggcacactttaggagctgtccatctccccagcgctgtgcgggtttgtctgcccattcaccctttacgccttctccggggccattcccttcccttgggcttagaagtccaggttcctctgagtggcctccccctccaggtcctccaggctggttccacctgcctgagcgcagctccttcgggtagagcctgtgggaagccaccgggagctggtggctgctgcaggccctcaaggccgtatccccaccttgcagctctttgacctcatctatcgtgaggagacgctattcaatgtcatcaagagcgtgacccgcaatggccgctctatcctgctgaccgccctgctggccctcatcctcgtctacctcttctccatcgttggcttcctcttcctcaaggatgacttcatcctcgaggttgaccggctgcccggcaatcactcaggaggtctggtgctcctctctgtgatgggtggggggaggggggctgcacaaatgatcaggccctgggagtgcttatccaaccaggctccctgcctcagtttctcctcctgggtcctgtggagggctagctcgtaccagtcgccctggcacaggctgagggggtgggagagccttggttttcggctccctaaggagcttcttgcttgcagaccctggcattcatgttaaactcagtatttgcagggactgcctgtgtgccaggctcaagggtgtggacccccttcctgccctcagtacacagcccggagctgggcaggggggacagggcatgaagacccttcattcgtagcctgacagtggggagcttgcaggatgggggaaggcttcgtggaggatgtgatgctggggacacgacgaggggaatggtacatcaggccagccatgtccttatcctgctgacctcagccctgtcctctctagccagccccctggggatgccacatggagctgccacgtttgtgggcacgtgcagtggggaccagctgaactgtgactccggggtctcggtacccgaggtcctggaaggtgagcgcagtgtgtctcagggagcctgggggaggggcgtggaggcaggtggtttgatgtgggtgtgcgcccacactctgcttgtagggaacgaagagctggagagcacggagcgggcctgtgacactctgctgatgtgcatcgtcaccgtcatgaaccacgggctgcgcaacggaggtggcgtgggcgacattctccgcaagccctccaaagacgtgagcatccctggccccactcccagatccatgctgcccaaggcctggcctagccagccatggtggggtcctgccctcaggtcacaggccggcagagcaagcagcttggccctcccaccatctgcagtgttgctggtccccaccatgcatccccttctgctctcccaccgagccaaagtcaagcagcgctcccaagcttgttgggtttccccgccccactccacttgtaccccccaccagctcaccgtagctgctctaaaaccttggcaaccaggctttgcccaggctagggaaggcatgagtcagacatcgggcggatccccggcaacactggcttcctctgtgaggcagggccccagcccacatttggggtgggcagggtggggaagctgagttggctccacaaggaggcctcaggatttgacttaggcagccaggcatcaccggtagtcagtctgtccccggtcgcatgggagcgagaagccacttccctgggccagacagtttccagaatgtgtgaggccaggcatccccagggtggggcagaggagttcagaactggctctgcccccaaccaagagtcaggggcagagacaagcctcgacctccagccttactgccctgtgctggactccttccatggggctcagcccagctgggatccggcatctgctctttcctgacctgcactcagggcttgcggttgcagtgctcgctgtcctgctgctcagagtgagcctggctgggtgggcttggcctccctcagggtcctgggagccagaggccttcattcccctctgctgagggcctggcctcctctgtcactgccctgccccctgcctgagtctggcctgctctggtgaactgggcccagcctccctgcctcacccctgcaggagtctctcttcccagcccgagtggtctatgatctcctgttcttcttcattgtcatcatcatcgtgctgaacctcatctttggggtgatcatcgataccttcgctgacctgcgcagcgagaagcagaagaaggaagaaattctcaagaccacgtgcttcatctgtggtgaggcctggttcctgcctcccgggctgactgggcgtgtgggggggggcatggcagcctcagtctggcccttcccaggttcgtgtggccaccagagggccctgccctggggctggtggctccgggactttttgctcaggccagtcctgaggtgaacaggaccctgcctgaacttgaggtcatagaaggggtgggaaagggcctcagaaaggccctgagaagggccttctcagtttatggaggaaacccaggctctctgacccccgttccagggcttttcccgctcctgctgtgaagtgctagtggctcaccacaggctaaggagcaggtgtcacctgtgggacagacccttctcggccattcctgcctgcccagctgctgggagcgctggctgccctgggcctccgcccccaggtggagggctgcgactgtgggggccgggggggccgtcactcaccttcattggcctgttaggccgaggacacacacccgctacacaccgagaggcggtgtctactccaccaggtggccccacctcggctctctgtcctcctcactccccctctgcacccccacaggtctggagagagacaaattcgataacaagacagtgtcatttgaggagcacatcaagtttgaacataacatgtggaactacctgtacttcattgtgctggtccgagtgaaaaacaagacggactacacagggcccgagagctacgtggcccagatgatcaaggtgtgaccccgggggtgggcgggacagttgggcacgctcgtggggatgccatcctcaccagggccccgccagctgcctatgctgccggaggggactctgagctcttctgcttgggcgctgttgtctggaaaaagcccacagctgacctgccagccccgaaaaatgtacatggtgtccccagggcctgtgggtgcccgaacctgaggaatccggggagcaggggccaccgctctgtggaccatcctcagggagccagctcagcaggaggaagggcagcttccctgagctttgtatggtcaggctgagacagagcttttggaaaaactttgaaactatcagacctaggaggaatcaaagttaatctgtgcaatttctgtagtgatgaagggagggaaggcagtaaattaaaaaaaaaaatcttgcagtgttttggggaaatgaagcccatccattccatcaaatgtagtacatcttcaaattcttgcacaatggataaattgcaggctaagagaaaagacgtatttagcagcatggcaggggcaggggacggggggagggttctatttgtttcttaagtttgtaatttgaacagatctttagtataggtttatctgtcggtctgagaactcatggcttgtgacaaggggccaggaaactggtggtcttctcctgtgtctcctctgtcctgggaaacgtggccttgcctctcagacacgtgtcagatgccagctgtcctcggcagagcctcctgtccctcagcgtgccatctgtctggctcgcagcttcctggggtgtggggcgtgtagggtggggtggggcggaagggaggaagggagggaggaaggaaggagcttcagggcctgatgcagaggcccccctccacctctcgtggggtgtgaagagagtaaacagatggtgtcaataccagtgggacttgaggctgtctaatggaaactggcctgtcaccacgctctggcctcaacaccccattgagggttcacggccagctctctggctccagggaggaccccgtcggtccagattttcccgtgacatatccctggggagcagtttgtccaggatgtgacagcaggctccccctacattactgcttctataaacaaggccttccgaggccaggcccaagcttgctcatcctgcccgggatctttttcagaacaagaacctggattggttcccccggatgagggccatgtcactggtgagcaatgagggggaaggggagcagaatgagatccggattcttcaggacaagctcaattccaccatgaagctggtgtcacacctcactgcccagctcaacgagctcaaggagcaggtgtgtacccaggcctatgctggccccaccctagggtcccatactctgcagctccagaccctcactgggaggttgcagcccagcctgccacggcggggaggggagggtgctgggaccttcacattctttcctttccttcttgggtttggggtggaagacaggttcggtacgcttttccccccgtggaaagctagactggggttcgcagcccctgtaagcaccctgaaggacatggccgagtggagccttggtgctgtgtgaggggtcctcccccttgcccaccccttaccctagaagctgctagggaggctctctgaggggtttaccagtgactggggaagtcaaggcatccttccacttgtcaagacctcctcttgcctagaacacccttctttccagctggcagtggctaagtggccttaggcagtgcctcgtttaggtggggggctggtttcccagttgcgcatcaggggtttgcgatgcaccaattaaggacaagggtttggggttgacatcctccgtgtaccctgggggcggggggaggggggcttggcctgctgccagtgctgaacagcagctgggcccagtgggcaagaggctgggcggtgaggtggagggcgggtgctgggcagcccgatccgacccgcaggcctccatctaatcctagatgacggagcagcgcaaacgcaggcaacgcctgggctttgtggatgtccagaactgcatgagccgctgagagccacccgaggccccgacaggggatggtcatcccggacagtgtgactggaatactgcccttccccatgggtcgggtggcaccagcccaccagcctcgcaaggcccagtgcccactcggcccctggcttccaccctgccggatacccccaggccatcccaggctcggccagcacggagtggggagccacagagccggcagtcctgcctagagctggagagacaactagacagtcactgggactcagcttaccctaatgccttagaggaagtctccggaaggactgctttgtcccttagaacagtacctgacattcctgtgttcctcctcgggggtcattaggagtgaggtcacctctttattctaagcactacatttgctctctgcctgccccccccccgcccccggggggaggtgcagtaatgctgttgttgctagtgatcttagagcttcgttatttaacttattcgagggtgccgtgttcaaccctggccgcggctgcaaggctccccgggcctcagatctgctgtagactgcacagagaccttactgtccaggccatccctctggcccgggcccaggtacactggtgacctgaggacaaagagccttgctcctgggacctgcctcttcctagtaggcagctgagaagagttgttggcctagaggacagggcaggggtgtgttcgagtggctggtttttgactgcttgtttgatctcttggtgtaacattttacaaatcctttggcctgagaactaatatggcaattgccttaaataaattaatagaactctagtccattagaaagggatgtggtttccgacactccccaggggctgaggggcttcatgtggcacccaggcagaggacaggttctgagcccttgccccctggcctcacctcaccttgggctcctggtagatgccctgggtgcatcctgtctcgcagcaattcctggacagagctgtactgcactgtaactggtttgtattttattgtatgtatttcaaagcatactgaggggtacagatgaggctaagaactcccctgcccttgttcccgaggggtgctgtcagcccctgccctacaccttctctcagctctgtccttaacagaagaaagcgcaggtgggggaccaaacactgaatacagagctaaggttccatagtaaggtgatcccatgtgtggccctggctcgggggctcttgtcctgtggcctcccacagaagctgctcagagtgctgaagctgactgcaacccaaggccccgcttggccaaggcccatccgaagccctgccccagcctttaagccaacctgaaacaacctggttttcctacaaggtcaggggcaggggactgagctgcatcttcctgaatcagtgagaatgagggccaagtgggctcttctcatctctgccatctttccctttgcagcaggatgccttcttcaatatttactgctatttttggctctcccccaggagctcctacaacaaaagggagcctgagaatcttgccagaagccagccagaccccccagctggcaggtggggctcccgtggctgctcaggaagcaccttgcccagaggtcccttcaccttcccttctcaggcccagacagaggccctcatttcctctcctctgaagacttccctacctgaccagtgggcggggtggatgctcaatggcctcccttctaaagaaggcagaagttaaaaagaaaaaaaaaaaaaaaaaaaaagaaggcagaagcttcctttagaggcgcaggggcttcctttttgtgaaggctggataagattcccaaactgcgaggatggggaaatcaggacagttttatttatgatggcaagatacaagactccacacttaggtgtgcgggcgagacaaggaccgagcccaggccttctgcttctcctcggtattcctgggggcaaacttctcctgcagtttcttccacattcctttattcatttccttaaactcttccaaagtgtctgtaataggggaagacaataaatacataaatagactgcgttttacaattcggtgatgtcaattggccccagaggcttttgccatccagatataccttgattttcacactgtgtgttcccgagagagggagtgcggccccaagttctgataagcaaatcagatgggctaagagaaaaatcactgctcgtatgaatcacttgcatagcaggcaccatgcgaagcactctgtacctctcgatggccagtctctgcccccatctaagctggggcccctgctgcctggttctgcaggagcagcaaagaaatggcactgccatgtcagtgacacatcctgcaggcccaggggcccagaggctttcactcaaaacttggcctgtgtcacatagacctaaccgtctccactttgcagatgtgcaaatggaggcagagggaggtgaggtaatttgctcaggtcgcacagctcagaagtggtggagcagggtggggatgggtgtgggggaacagacctgggatgggatccccaccaatcaattcctcactgggaaacaaatgatttaaccctgctagcctcaggttcctcatctggtggagattgaaactcctgcctcaaaagtcgtggacggaaggaaataatagaagaatgtgttggcacccggcctgcactcaagaagaggtggccagcttcatagctacgaaggtggcagtacgctggcccgcaagaccccacaaacgcaaacacactcacaatccataggcaccacaaccagctctctcagtctcagcattacttaccttttgggccagacaatcctttcttgtggggctgacatgatcatcgcaggatgtttagcagcaacgtggcctctacccactagatgtcagtagcagccccctacccggcccctagctgtgacatctaaaaatgtctccagacactgtcacatggcaatgtggcagttttgtcataccccccaccccccaaccagtggagaaccagcagtctaaagtctctccagggctaaagttctacactacctaattttatctgtattttaaatttagattttcacacagtattgtttaaatttcagcctggattttcacgggttaaccgaacttctagagaaaaaagaatagcttttaggaacaaaaaggcaacttagattatcatcagtggcctcttgactaaattaggacatacactactgcagccaggagcccaacatcccaccctgaaaccttcccagaagtccaggtttcctcaggggcacaaagtgggatgctgaggggccccatccatgtgtaagccctgaggcctctttcagaggcgcccatgaccccaagcccaggtgaacacacttgggccccagactcaccaggccctcaaacactgtacggtgtgtaatcttgccttgtcagggaaataatcagtaagcctatgccacatagtcacaacaaaatatgaggcttatcgtgaaaacaaattatcagcaaatttcctggagctgaactcctggccaaaataagctgcagcacagggtgatagtggggagtctgttgccccccccaactcacagaggggtccaggccctgacaaaggggatggaggccgggattctggaacttatttccattctagtttcaagcccaaactttgttcaaaccctttgggaccctcaagagtgacacagggcatcaatgcaggtggttatgtgggcccagagatgggaataaatttatgtatgtgttttagaaaattgttgataaagtaattctgcttggccaaaatatctttaccccagttttccagagtactgtaacaaaaagaggatcagagttgacaccaccaggttttacctgttcagagggtaagcgttttctggaaggccaaatccccaaaatttagttgctaaaaagctgccaaaggaataggaaagagaaatttccagagtaccggaaggcaaatgtttcagggctatgccctcccagaaaaggttagcctatttttgtatatgctagccttggcaatacaaatcgtaattttccagaacttgcctactttaacccaggctccaactgtcactacccccatctcttcctttggtgacaatggagatggggaagtaaggaggggatgtctaggcagggtatttcctttcctgttaattgaggtctgtcaacaactcccaaatgtacctagttaaacccatatctaacccacaaaccatgtcccctgggtcaaaaaactctttgacgatatccctgtacaagtttattgaatacctttttgttttaattaaaaccctcattgtttataaagctcccttaggaccataaaaataaaattattttccttccatcctgatttaaactacttccattttgcaaatatgtattcccctgttccttgctgcccagccttgaatttaaaagctctaaagatggattttctttttttaaataaatgtctttgaccttctccatattctatggccaaaaagcatgccctgaagcttcagaatttcctctgggctattccacaagactttccatcaagcagagcagtcttaatagacaattccccttggctgctcaaactcaaagaatcatttgcaaaccaaccagaaaggggcagcagggcttcagtacctgtggacaggatcagcttgtactcttccacagacaggccactgaagctcgtgtctctggggcgagggtactggtcacatggggagagagaacagaggagggattacttctgcacacaacctgagacctgacgaaccgggagaagccttgctctcctggcacggttcaccagtgggcctctacaaaccagagactggctagaagagcagcgccacctagaggtcaaagacttggccttgcttgaatggacccaagaatcctgcctgtgtgattcgtgtctgggtgtggcccacgattctgcacttctaaccagctccccagggatgcccacactgctgctcacagaccccactttgagttgtgaggatttagaagaaatcccttttccctgcaggctaggcatttggctgtgtatatctctggagttactcaacatactccagctcggggaaaaccacattaaatggaatttgacagtaatcatgtcagggctgaggaaaagcccagctttgtctgacaggactttcccgaagcatccctctttatcaccagtgtggggaaatgccagctccatcagagtagatgggaaaatatgggtatggtccaacagttgtcagatacaccctgagcatacaatggtctataaaacacatggctttagttcaaaactataaatagcttttatttaggtgacctaaaagcctctaccaggtgcctctgttagtttggttgaaattactggttacatttgaaagtagcaaaaccccaattctttacaaagcaccgcagaatcagattttcacttactctcactggtcctttccagtaggagggctggggttataaaaaagaccggcccactcaccttgtgtttgtaatagtttgaatggagtcttgctaagctctcatacatctgatcacaggcctcaggttctgcaatctgaaaaacaaagaaacccccccatgtgagcaaacaagccctgcctcccacaaggagggtctgtacttccaggatggaccccacttacataaaggcattcaaatgaagcaggcctgcagcttagcactagcttctccactctgtggggagcaaacttggcctacagctccagttattagaaagctattagaaatcaccttttcataatggctccaccagatcaactctccaaccttcagaaaaactccatcaatcaactggcaaacaaacatcagttgagcacctgcatcaggtactcacagttgagcagctgtgacctgtggactactacaatggctgcagtggaagccaccacaatgaaaatatagtatcaggagggtgaaccttttggcggtgtgggctgcaagaaaccggagggggcattcgtgtgctcagtgtaggacacaaatgacactaagctgggttctgaaggatgtacaggagttggggagcagaagggagagtgcagaccctcctggtggagggagggtatgagcaagcggaggcatggatactatctcagctttagaccagtctggctgagggcctgatgtgtaggtaagagcctgggtgggagaaagagcaagagctttttgagttaaaccttcaatacaaaatgtattaaatatttttttatgaaaggcaaaataaattgagctttcatctgtggtgagccattgcaattttacaaggaaagaaacatgacgaaggccgtggtttaagatcagataggtgaactgaggagaatccagaggagagtccaattaggtcctgctagaaaggagaggccctgaacactgatgccgtgagagtagaggaggagaaaaccaagagataacctggtgcccctgctggaaattgcaggaaaggtggacacacacagatgtgaggtggtttttccctgttcatctctctttttagttatcccttccttctgcccttgctattatttacctactattccttacatgattctgccaagaattctgaaagctccccagaaaaaaacaaaacaaaaccctttctcttttatgtttttccccagaattcaaatgatggattttccaacttaaatcctttcttgaagaaggcaaagcataaataagtcagcagttaagtgttttaataaggcagttctgcttctgcctctgtgcatgtgtcaaatgaggttccccacttcagagccaacaaaaaaagacaatctgtcatgtagtttcacttgatccatccctgggttcaggccactcatcacgagattgttcaggtagccacatcagaaaagagaggattctgggctgaggaggtagccagtgttcgctgaataacaaaggcattacttgggtggactggtgctgtggactaaacagaaagaatggatggaaaaatatgagaccaggactgggttctgacccctgcaggacagcttttctggagagtggggtgtgggtggggtgggatgtgtggggggatgtccagttggaacagaattctgcagctggcactttggaggaaagcattttgaacattatggtttcagcagagcatgcaaaactgcgagctaacacggaagctaggagaacagggtacgagacacaaaaggaaaaagagaagaatgccagcatcaaggtttaaatatcacgtcggttatcaaaagaaaatcaagcatttttatcttctgcttgtggcttttattcttgtgtaaacgagttcacttacaaatttaaaaatcacgggcacctgggtggcgcagttggttaagcatctgccttcagctcaggtcatgatctatctcagggtcctaggattgagccctgcatcaggttccctgctcggcagggagtctgctctccccttccatctgtcccttccccccacttgtacacatccttcctctctcaaataaataaataaataaataaataaataaataatcttaaaaaaaaaattttttttttttaaatcatgcatccagaacctgcagcgtgctcggcctgcaggtatgtgcaggtctccatggctatgaagagcagtggagttgcactgcctggcctggaatcttgactctttcacctatcagatactggatgctgggcaaatcacactctccccctatcccccacactttagaaaaaaactgccacatttgctttatcacactccatctctatatacatattttcccttctgatccatttgaaagttgaagcgtgatgctccttcatgccataatatttcaggatgtttcctaagaacaagggcattctcttatataacgatggttcagtgatcaaattcaggacacctgacattgatgcaacacttttatctggttcatcatccatattccaattctgtcaattgtctcagtaataatccttataggaaaaaaaatattctgttggcctggcatcacccatggcatttatctatcgtacatctttctcctttcagctgggacaattcgccagcctttctttgtctttcaggcaccgatatttttgaagcacacctgccaacttaacctttcttttaaaagaatagataataatagtccctatttctgagggcagtgcgaggaaaaaatgaggtaatgcctggactgctctgaagttggggcccagaacactataaatatgagtgattcgcttttcttagtattattggtagtcaacagttgtagcaggcctccacctcacagactatgaggggaaagagtagaaccattcaggacaaccctggagacaggtgattctggggcaggcgaatgaggggtgctgtggccactggccagagtagacctgccagccagagggtcatggctgaggatgagcagcagctaccagagggaagtgggggctctccaggcacagggccagttaaagcacacgcccagggaagaggcaatgagataattctgggtggatcagtgttgctggtgtgaccaccgggctgtggctaggcatagaagtaacaaaggtgtggataactgccccatctgatcatgccaccggctctgacccagttgggtctgaccctgttggtggtccctgcggccaccaggcaccccagtcagctcggtggggatgaaactctgatccttgggtctctgccaaataagcagtcaactgtggcacctttcttactcaatgggttgtttgtctggaccttccccctctaccaccatctgaccaccttcccaaccgaggtcttaggaaaggcattcacacctgggatttgccctcctcacagctctgctgggctcccatcactgctgtcaggccagcaaaacaacgtttcttgatcaaacccccaatctgaccagttcctcgcccttagaaatcttgcccatgcaaattcccctcctgcttctcctttgacttctctaacagtgagaatttaccatgggtctactcagctcagctacctactataccctcaaaagggtgagcaggtgtcctcttccttccttttagtattaacgacacagcctcctagatatcttacatgatgcctgatgctccattgacaatccaagaaggaaccaaatgcctaacaataaccaatcaccaaaaaatcacccaacttcttatttgaggtcagaaggtgtctgtatgaggctgtaagcacagcttgatggaggtgatgagaaccacgcatgccaacttctagccacttgttactgccaaagggcagaacagccatggccaattctgggtcctgggcacatccaaccccaagttcagcaatgaaaacagtctcgtttaccacttaaaaaggtatcaatagaaatatctatctaattccagaaaccttgccacactcctacatcctacactttattcagactctggcacaaacgtttctgaattttgaaatatacagttttcctgatgaaatgtactgtgcacttttagaagtattcttatatacaagctttaaattacctgattttgcattcacacctaatgagattatggacattttaggactaatagcagctctgggtttgaaaaaaggcagcagtgggacattatgaaaaattcagctctgctccttaaatgtgaataaaatagatgttcaactgacatagtgtcctttatggctctatttttgctccttttgcatttcccctactcagttgtcagaaaatttctctttaccatattaaacttttatacatacaaatctacatcagggccgcaggcaatgatttccattttcaaaattgaattttgggtggtgactgcaattggtacacacagcggccctgattctagtcacacaaagggacgcataagcacttttggaaaagggtgttgcaaattgctttgctaattaaggtagagctggattcgggccaggaggatctatgaaaaaaggttttcacggctgggtaatgaacttctggagcctcttcccttcaattcaattgcaaatctatttcttgagcacctactatgcagactgctctgctaggggctgtgagaggacgtaaagactgggcctcggccttggagaaactggcaatcaagctgaagagacaaggaatgcacgcattaaaaaccgaacatggccctggggcagcgtgtgattgagtgctagagacacagaaaatcaggggtgggagtcaccaggcttgactaacagggcaggtatggcaggggtctggttccactgccgtgacagttcacagagtgagggggagccagagtaccacaccgaggagaggagtacagtggcaaggctggagctggatgtggctgggagaacccatgaaaaagcagaggacaaaggtgttttaggtaaagcagggtcttaagcgagccaaggagtgcttcgagggcatgggaaggcagcaagtcttggcaagccttgtgtgtttggggggatggtgtcttcagagcactatattctcaagggttaagaaccacttctatgctggccaatctgggaggcaaggagaggccagggcacatgctggggtgtggtgaggggcaaaacacaggctggcaccaaagatcagaggacagtgaaggcctcacaaacctgcctgccacttgtccaggaggcagaggcagacccagagagctctgtgcaaagtgcacacccactgaaagtgatcaataatttatccctctaggaggaagagcacgtacatctctaaacaagcacagaaactcacatcccttggtctaaacactaccttaactctctctggctccacctggaactcggggaagagaaaagatggagtcgtctgcattccctctcagaagactctcctcacaactcctgttttgcagtgggttcaatattatagctaaaaatagcatgatctatccttaggccatccttaggcccacatgtgggggtgggcactgctgagatggtatcaccgccgctggcacaggccaggcagttgtggggctagctccttgccacactgaggaaggccaaggaccagggctctgctggatgaccgagacaacaggattatatacaatcttcacatactcccccagagaactggaaacatcatttacatcactgcaaacccaagatacagttcaacttttttccaatgagattggtatgatttaaccctggctataatgcaagaattctctggctggtgcgcagtcaagaatctttcaggcggttgcttgtgcacctagggaactcattagaaggactagcccctttccctgtacttaagctaacaattagagttgttttgccaccttcccccacgttgtgattctatttattaaagctcctggtgctgcaggggacctgttttcttgaagaaactgtattcaaaggggggcaaaacccataaccattaactttcaaaataccgcacaaaaggacagagggtgtaagaggtgttaagtgtgttcctgcttcccaccatcacttccctcttggtgggttctgggtggaccgtgagactccccaaagggcaatctcaagtggaataaatgggaggcggtggtttttgtattctgctttcaagtctgaaagactgatttgctttctagggagtctggcccttctgcactggtgtcctacctgagagtcatctttcttcctatttgtactacgggaggtcgcggctggggcaaagaaaagcgggtgggtaaacacagggtgatatttgctttcagcaaaactgtcattggttcagaaaggtttgtacaggagggaaaaggagtagcttggggttcatggatcaagaggactttctagcaagaaaccacttggagaaatggcagctgaggaaagatctggcaccaaggaggcaacgccaaatcaggaccaggtgttgcttacttggcttgccacttactcccagcggaccctgagtaagctggtttcggtttctgattttgtttccttgtctgtaaaatgggagtaagtgatggccaacttactcagctgcactaaggattaatttaaatgagaatatgcatgcaaaagcatacggaacacgtgtgcagtgttactgttcagatgcaggaagccaagaggcggagagaactgcctgtccctctcctctacgggaacaaggaggctccccctctggtctggtctttctggcaactggcacaaccaagggcgagttccctaaccatcagccaactggtctaatgcctgctgcttgctgccagcttaatgaggagtccaccagaaccacctttctttctcaaggtttataaatgatccgggggtgtcagtgggagtgactcacagtgatgttctcaattctggcaagagggctgctccctctaaaaaatatcaccaagatttactaagcccagaagtattctcaggtgacattaggatgaggtaccatgacagtggtcctgagtaatgtgcttgctgccatcatgatatgttggtttgctctactagggatacattcatcagtggctccagaaccatcaacagagccaggacttgcatctaaaaccatgactcaaatctgtgtgggccttcaactgattagaactatttccccagctgatgacaaaggatgacaactccaaaagagaaagctctaccctcctttcctggatccccttacactaagtcaagtcacactctctcacctccccaagggcccaaccactgtcagcttttctgctggctgctttcaccacttgaatttcagtaaattaaattgcatgtctacctgactataaaatttcttgacggtaaggagcagactgtccctcttctagagttcctgaggttccccacacactcaagctctcaaattaattctcaccatcaggacacagaaatattccttctcactcttcactgcttctctccatctaatgctaccacacctgcaactacattcaaatgatttttgtctcatgagccataacagatcatttatttaatctattcatctagggacgcctgggtggctcagcggttgagcatctgcctttggctcagggcgtgattccagatctggggatcatgtccacatcaggctccctacagagggcctgcttctccctctatgtctctgcctctctgtgtctctcatgaatagataaatttaaaaatccttaaaaatctatccagatatttacggattgtcttttatgcaccaagaactatgctagactgggcaggggcgggggggtgggagataaacagcaccttctctactctcaggaggctcacactaaaaatatgtagggagcagtgccctacgaagtctagggtgtttgcagagctgggatgagatagaattcttgccttcaagatctttatatgttgggccagtgaagacccttgtaaaagatgtgttggccgagtgcccccaccaagctctaagccagacccttcatccatgccctccacccaatctggaatctggtttcactgatgccactgggcatgttctaactccttgagatgggctggcttggctctttgttgggctaagttgcaaaaccaaaccaaaccaaaccaaaccaaaccatgttcctgctttgttgtggccaagtctggcaaaaagtcctttcttcaggtcctgtgtttatcacatttcctatctctgacctcttgcctgagccccaggctcaaatatcccactgtctacttgacatttccacttgggaggtaagtccacttggcatcttgaatttaatgtctcacactgaattcaagatgttcttcccataccctacctgctcctcatctagtctttcccatctcagtaaacggcacctcctcccacctggttgctcaggccaaaaaaacatctggtgttattctttcttgccagaatagccttttctctagcctccttgtttctctccttgcccccataatccattcaccacccgcaaccaagatgatttttttaaaacaaataaattaggtcgcgttagtcttcacaaccccttcccggtggcttcttgctggccttatgataaaatccaactcctaaccagagcctagaagaccgcactgcgcctggctcttgtcctatgatttcaactcttagtaaacgaaaaaaccttcctttttgttccttatcaggccagtgtgcttcctacctaggacctctgggtggaatgcccttccgaccaagtatacagtcagctcgtcctcttccctcgcgtctcatctctgtgtcacctcctgagcgaggccttctctacctcaattagtactaccctttgatcatgctattctgctttgccagcacggtattgatctggactgacctatgtccacttgcttactgtgtcccagaggagaatgtaaacttcaacttcaggcgaacaggcgcttgtctgtctcccagcacctagcacagttcccagcactcggtgggtgctcagtgagtatgtgctgtgtatgaatgaggcccagagccgctgtagcaccaacctggaggagagcaagaacgcaggtcggctacgcacacagggacaggggctgaggtcccgaacctgccgcaccgggctcaccggggcgcagggagcacacacgggcttagctggggccctgcagaggtccttgaggtttagctcggtcactgcacaacactgccaggaaagcaccgtgtcggggaagctagaggcctgtgaccgtcgccacctgcgaccgctgtgcgtctcgacccaggctgcaccctgaatcatctggtgaaagttaaaaaatagagaccaaagccccgcccccaggggctctgattcccgaaggctgaatggttccggacatctagatttttaaagagcttcttcaggaattccaagggcagccagacgagagcgctgagtaacaaagctgggtcgccgccctccgcagttccggggcggggggtccgcgcgcacgtgcggccagggaggaaggcgcgcgcatgcgccgaccccgccgctctccgctcgtaggccccgcccgcgcctcgtccttcccgcccctcgccccaaccgccgccccgctgcgggcggaccccacagtccggtcacctgggtgttctctccctcccgaaaggcctgtgctacccgctgccgcaggtaagtgcccaagtcccggccccgtttgctctcgtccactggccattcctcacagagcttaaggaaacgccggtagcggctggccgccatcttgggccccgcctgcctccgcccctgagggaggagcccgcgcaataggtggcgcttgcgcgcttaggctctccggcttcctgaggaggcggggcgggagggaggaacgagcatgcgcgacttcgcgggcgctccggggctctccggatggcggcgctgttctcctgtctctgcggtggagctggttcagtgctcgtcctcgaactggccccgctcccaggggcgggtgagacgcggagcacccccagggacaggtttgcttctcttttcagtgactgcacagtctaaaaaaaacttcctccgagacctctgctgatttgcataaacgaatatatttgcatgtaaatgcagattgttattcgatgaagatgtgtgtggacttcatcccgtagcatgctcgagttgttgttcgcctccgctgctcccctctgcagctcctgtgcttgtcactacgacttggcactgctccgcagctctcgttcctctttccccagcccctgttggtacccctttcggagtcccccccccaaccccccatcgggcacgtgtccctgggaggcgcagatttgccagcttgagcaaagtcagctgggttgattcagcctgggaaacttgtttcacgaagtcttttcttatacatctccagctgcagcatcatgtggaatgtcatcatttttcttttcaagctacccccaccagttcccttaagaaatccgcagcccagctttgctgagccaggctcttgttttcactgtctgcatttagccaggaccatcccctgcatgcaacactcgcctcccccaggcctcttccttctcaccctccttctatataaaggtaaattcaggagactcttgccttcaaggggtagactgttgagtagtgaacacacaacccaaacacaggttcaaagtgacaggggctttgattgaagtgttaggcaatgctgcggagtttggaggaagaaatgctacttctggctgtcaggggagtaaggggagaaagatcagaggtggcttctggaggagatggcatttgggctgaaccttgaaggacggttagggtttgaataagtgggaacaagaggttgctgagcagcaagagccaggcctggggcaggaatgagagggaggggtttaatttgaggaaagatcagtgggtagttttaacaggaatgagtcagctttgaactgttctgaaggtcttaagagtaaagacctattgaatgagaacctctggggacctggggtgtgcactgcccacttgaggtaagtgagttcagggagggcctacctgaggctaggagagctcaggagtggaaaatgaagctttcacgggcacccccacctcattcccagtccagcagtacctcccagccctatcctcctcatcagctgtatttatagccacatagttttgatggctgccatgaggcctaaaggtcaaggattatatctgtttactgtcaagttctgggtgcctagggctgtgctgggtacctagaggtcttgtcattctgcctgaggcctgaccacagctgtgaagaccacctggctggctgacagagtccctaggaggcagggcctgaggtccctctgtcttcagtgagtggaagagtagcattaggtggcaacaaatagttttcactccgcttgaggcacaagtggattgagaggttgagaacaactagacagttgagttccagaacaactggaactccttctcaggctctcctttccctagcacaatgtcttctagaagggttgtggttgtccctggttcagactgccctgcccacctctctcacccgctggaggcttgtttgttttggtgattcagtagtgaggccttggcgtcttatagacccgagttggaatgtgggcttgctcattgattcattcattcattcattcattcattcagaactatctatgtaatctgtggaggcccaggatgaggtgaaaatataaaattccttgttaaaatattattaagaatttcaagacagggcgtctgggtggctcagtgggttaagtgtctgcctgggctcagatcatgatctcagggtcctgggattgcaccccacatcgggctccctgatcagtggggagcctgcttctccccccggcttgtgctcatgccctttctctctttctcaagtaaataaataaaatcttacaaaaaaaaaaaaagaaagaaagaaagaaagaatttcaagacagtaacagccaagcgttaaaccagtatggggcttttgggcactcagggctctgtgtgaccacacaggtcacacacccatgaagcagccctgggctcctcccccatggtagacgagacaggcgagggcctgatcctgtgagttttatatttaagtaggtggagatggacaacaactgaacagaactatgataacaataataatagtactttttttttaaagattttatttattgattcatgaaagacaccgagagagagagaggcagagacacaggcagaaggagaagcaggctccatgcagggagcccaacgcgggactcgatcccaggtctccaggatcataacctgggctgaaggcagcgccaaactgctgggccatcggggctgcccagaactatgataacaatactaatagtactttgtatgtgttaagtcgtttagcaagtgaacaagataagatttgaggcagggtgctgggtgcacagtgattggggccagggtgggtctgagtggtctaggggagggctgtgtatgagagagacctgagtggcttcctagcatgggggcagcagaagccttcagggcagccagctttgagtgggctatttaatctctctgagctttattttattttattttattttatttttttaaagattttatttatttattcatgagacacacacacacacacacacacacagaggcagagacacaggcagagggagaagcaggctccatgcagggagtctgatgtgggacttgatcctgggtctcaaggatcaggccctgggctgaaggcggcgctaaaccgctgggctatccaggcggccctaatctctctgaactttagttcttcatcttaaaatgggaattataatgataaagtaacccttctctgggtatttgctctgtgtttggcactgtcctaatgcctcatacagtagtggctcatttagtgttcatgatggctctcagagacaagtactgttattgttccaattgtacagaggtggagacagtacagagaggatgagaacttgccaaggtcaccagctggtaagtggcagaacctggacttgaaccctggctgactgagtccagagcctacacactcaccccctgtcaggaggccccttcggtgttatcatgaactgcatacatggtgtcttttgggacacgtgacaggttcccagggggctctagggccctccagccttgttttacctgtgacccccaccttctgatgcctgtgggtggtcagagccagagtctgggcccattggcttgtcagtcacccagcgccattctggacacattaataagccttgcctggaatgggacttggcagttccagtcctcagggagttatgaccattttaacacccacctgctgactgtcactcattccacagtgaatgcccctggctccttgaaaactccctcccagagctgtacctcccgacccatttggaatgggtatttgggctctatggaatcctggttgctttttatagaaacagacaccatgggaggggaggggaggggaggggaggggagaaagtaagcactgcttcagtttttcaaattataatgatcctggtaattgagacaccaaattgcacatttaaatcgcttgaaagtaaaaatatcgttttgtaatgctggtgttaataatgtaaacattaaaaacgaattaaacacttagctgtattgtggagcatagttgcctgatttttcttctttcaactctttcaactggaggaaacaattggctacaatacctagatatgttaccataaaaagtggtctggacttgcatggaagaggttagtcagttaatgcccctgcataaaggtgagccagaaggggcaggctggtggtatattgctgcctttctctggaggtgagctgctttttaagattcacaggtgttggggctcctgggtggctccagggtatgatcctggggtcccacatcgggctccctgcatggagcctgcttctccctctgcctgtgtctctgcctctctctctctctctctgtgtctctcatgaataaataaataaataaaatcttaaaaagaagactcacaggtatttaaggtgtgctggggtaggctagtggtgtcctaaagcacagcccagtgaatgtacccacagttccttggctctgtgggaaatctgtcatctgccctgggccctgcctcccttcactctgctctagttgaggtcacctcagagagaggccttccctggcccccatttcagggaataggcctgctactcttggtccctgcaaaacgctagtcactattggacagcaggccctggcagagagtcacctctcactaaatgaatctgaagagaaccggcaacatcagagtctggagctgggatatccccgcctacctgttcccacccagacacctgcccccatgagacactcctctctagaggtctgagggagaaaggtaggaggacacatcaggagcaagtggatctctagatttcttgcttggattagccgtttcagggcagcctagtcacagtagggagaagttctgaaatgaaattacattataatgaaaaggacctaacctggctgcaggtcagcctgcccagctggtgctcgacttggtactgtcccagagctgctttccctccctcccaccctccgtccctctagttcttggcacccatgccttcattttagttctttcctcatcttctgttttatgtttttggccactgtggatgcagatgtaaatcaaaagtcagaagcttagatcattttgcagagctgctgatgagtggtcttgccttgccatttgttttaggagactgcttcctgccctttccagcatgggctacaagactccatgcggcggggaagaatgatgggactgccagcgtgctgcccagaggcccagggcttcctgatgacatcgcgtcatggaaaagctataataacattctgctctttagcttcctcttcaatcacaccaggaacgccagagggaggagacaggtctgggtgactgtctcccaggccgtcctagtcctccctggtggggaggtcaggagcagattgctcctctatgtcacctgtctggaggaccaagtgaaagttcctggggggcagctggggtcgggagacgtgaagcaagtctaccagctccctgggctcatactcactgtgtgaggatgcagccgggcgaaggatctgcatcaggccactgctgacaggaggattatggaggttataacagatttgctggggtctcctcgaacctatttccttttctaggctcatagttaaagtacatctcagcctgctggcatctgagcccagggctagttcttgtgtctggaatgtgggtgtgccttttctgtgtctgacttttagaccttttggttgattgaggaaggtccctggatgactgtgtggagcagagaggctctctctctgctgactaaacctgattgtaatgttaagctactgttgtttggggattgtttgttataatggcccaccctgactaataattgtgcatttctcagtttagaaaagaagagactccccagtccagggaaggggaggccagccaggaggcgcttccagacaagagaagaggcgggaggtttggaggtccttgatggtcctcaagtgctgagttttcttcacttccatcttattctctcttggtgcctcttcacatcaacccctgtggccaacacctaccctgctatttcctgagcaaaatgcttgcttcctatccctgtgcttgttcataatacctgctttctttataacctctgagacttgcctccctttcagggcacagctcagacaccacctccatgaactccccacatggctgtgagttctccctgcctctcctctcctgataatagtctgcatggctgagcaaatggtccccaggccttgtttgaagcacccctgatattttcacatgatggtattcaccttttcattacgttataaggttcttaaggataacgacatgatcttcacacacttccttgtttctggcacaggtctcagcactgtgccgtatataccaggcactggggaaatatttattggttggatgaatggaaggaaaggacagaataatgtaatcataaatgaatgagctactcagccagatttttaagtgtctccactatctgggctcactccatttctttcctcttcattctactactcccaactacaaaatccccattctggatgggttggtctgttcagactcatgagcatgctggacttttccttctctccactcagctccttccccattcttatcaccattcagggcctaaatgaagtcccaccctctccaacagtttctgtgatttgtgtttctgtgttagctgtgagctgacctctgtgaactttaggattgatcatctgcaccacacagatgaatcctctgtatcactgggtaccttctttgtgcggtttgttgttagttcacacgtgttattcttgcctcctagaatactagaatctatgctcccaagagctggatcttcttcagtgcttagcaaaaacagggaagagctccttagttcagtgtactcttaatggttactggatactccgggccccctcacctcttttgccattttaaagtaaactgccattggatatcaaatgcattcatgctgacgatcttctcttcttcccgtatctctctgatcttctccttatgcctggattttcagtgctcaagtggactctttcagctgggttagcaaagccttgtacacatttctagacagtggtgactcctctgagcccagactcctctgagtctgggaagcacagtctaaaactggtagccagctttgccccttgcaacaaactccacctttgttggtgacatcttcaggggtatgtgggatttggtctgggcctcgagggcttggcagagggggaaggcctcctgtgaagggcactgttggataaaggactggctgagggaaaaagggtcacgtggacaggagccaggagagtgacatgcatggccagccctgaaagactaatattctagctaaccgcccccactccccatcttcaggcaggtcccacaatacccagggctgagaacagggacaggaatcagaagctaaggcagggagctccagatttgattgaaccagatttttaagcaaggaatcgccctagaaaaggcagtatttagggctccattttgtctttaacaaatatttagtttttggttgacttctttttgccacccaacatactttgtctcagttctcccatcatgagtgcagagcatgcaaattaatcacaatgttacctcagccacacatacttaaggaagttaataacttgctttgaaatccatataatatatcctaaaattaaacaaacaaaattttttaatccaagccactctttccttaagtgtggattttggaaggttgatggtaattagccacgagaatacaaaaattatttaactctatgttatagaaagttcagataaaaggaccacttatgaggtctggtacctgccttgtagatacatggaaatacttgattagctaccgttttccacccaggatccccaaaggattgtaggaaatcagtgaactgttctttctttcttttttttttttttccagggaactgttcttgctgtacacactagtcgcccataaattggaactgccatacagtgtggtgatcagaataaacaaacagaaagggtaataaggcacaccaaataattactggtgacctcagcaattttattaacaaatttatttccctaattgggtaacgtatcttcatgctcgactcaagggcattgtaatgggtttccacactgcagaagaactaattaattaggactgtttgctcttccgtatttacacttgtccaccagtcttgtaaacattacacctggtttcctcggccctccagccttctctctcctgattcccccaccctacccccaaaataaataaatagaaagcaaatagtataatttaacatcagtagctcatcctttcgtgcagtccacccccactggaagctgcatttcatggttagagccattttgtggccaggatctagtcaagttatcgctcccaataggtacttggaagtctagaaagagacccttgtctccatgggcaaaaatggagaacctggggtctcgatttgccagggctgtgtctggattgcccttgcccattcagaccctgggtaggaagctggtgagatgggcagatctgccccactccttcctgccccacccaaatgcctcttgggaaggtaggagacagtcattcgtgagctccagaaaaatcatacacttgtgaactcactgttcaggtcttcttcaagtagagttttttgcctcatagcttgccaagacttcagtgtgacaacaaaaaagcatttttggggcagccctggtggctcagcagtttagcactgccttcagtctggggcctgatcctgggggcccaggatcgagtcccatattgggctccctgcatggagcctgcttctccctctgcctgtgtctctgcctctctctctctcattgtgtctctcatgaataaataaataaaattaaaaaaaaatttttcaacgcaaattctccagaatcttactgtaatgctggcttctctctcatgccgcagccctccaatgtactgcaaaatggtgccatttcacactgactgtccagtctccaatgaccagcattagtataagatgccagcatacgtggaattccctccagagctagtttctttagcagccagtaatatacctgccatgtatggcttttgaatgtggatataattattacaaagacatctaacagtttctagagtaccctggctggcagtaggtcccttttgagatctagactccaaaaaaatgtggataggcccaacaagcctcattctccctcttgaatatcctgtaggatctggatgaggttttctaggccaaaaatatagcccggatctggtccgtcataagtggtgtgttcgttccaggagcctttgtatgttgtgtgagcaaagtcgatcatccggatgtcaactttggtgagacctccggcagagatgccatgggtcgtctgcggagcctcctgagaatgcagacctcctggggtcctttctggcagctcctgcccatcatagatgatgaggagagagctggagtagaaccgatatgaactctggctcctaatgaccgagaggagggcccggagctggtgctggatgggctccaggagctctgtccggaggcgggttccgtcatgcaggaactgatggagtgcttgtcggaacccctcaacggagagttttcttccgtaatacttgtctttgcagagaaagtgcttcttatcaacttgataaaccttataataaaaaaaaatgtgaagaattgccaacttaagaacagacttggaactgctatggttgcagtgtcagaaactaataggatatataaacagttttctgggagatgcagggcaagcatggctgaaatgaatggaaggatgatctttcatcaagcaccaggggatctttcacatttcaaaatgctttctgtgcaagcttttaataggaatccagggtctaaatattcttcaccccacaaaggtgatcctccacccaggaggaaaagctttggatcacctttcttgtgaatttccagtgtcatcctccaaatcatgatttaaaccctggcttctggccctcttcaattcaaatattagcaaacccaagctagaaagcttcagtaggaatctgaaatcacagccaatggccttggaaagccaactagattcaaatttccctaattaagtttataaagtcctttctctgcagattctaaggaaacaatcatggctcctgaggtaaagcagggttgactgaagataaaaagatcaaaagacgggctggatcaggtatgggtggggttttcaggcagccagctcagctgaggggagcctcacagcagccctgggaactggtggctcctccttggcaccagcacctcctctcccctgtcatgtcttggccaccagaaaggaacagatggaggagatgctgatggggggtggggggacagtggcacccgctcccatttcattcagatggcagaggcagaggctgtaccaaggccagtggctagcatggccgtgacttggcacacctctacctggcacacctgggaagggcagcccacacctggccaagatagtttctcaggtctttcctaccttcagattatgtggtatgtttatgggaagccagtgctgaaaaaatcagaaagatatgatagacttgctttggagggctgaagatgggctgctaaattagctgtcataaatacatgacaggtgtcattgtctaaataaatcagatcattttcagaagattggaggtccagagagagattccatttacaccccaaatcatcacactccattctcttgaggactgcattccaaaccttccaagggacatctgtgcaacaaatttatagactccacttccagcttcaagggtggcagtttcaattaaggaaagctttaacgtgtaccgtcaaattggtgtctggttttgctttggggagatagactgcaaaatcaaacgagtggggaaagtttatttcttccctttcctatagcccctgccacaggccacatcagagctgcaaaactggggtagagtctgggcagtaaaaaattaactttcctttgcctcagcaggctacgatctgcttaattcattaaccagaacaggtagcagacaacaacaacaacaacaacaacaaaaacccagaaaaggtggagtaggaagaaggaatggcttctaagaattcaaaaagcagagtgctgtacagcactggagaaggagagggttcagctttatccttcaagagactgagaaagtcacggagtgcacagggaagctctttttcacgtctctccccagcccctgctcacacactgtcatcagaggtctgctgtcaatatggacaggacccatgtggccactgggaaatttaagctgccagagaccctgagacagagtttaaaaaaaaaaaaaaagtgactttttggcagcactttcctgaaaggggctcttatagaaatcccagtatatcctagggtagatagcgtttcctgcctgggcaggctgtgcccagctgcctcctgtgtggctctgtacacagaggtgtttgggagacacgctcatcgccccacagtggacatgccaggatgcccagccctgcacctacctgcatgccacagatgcgcacgcccaagcaggccgaggtgctctgcgcacacttcctcatgtggcgggccttcttctcctcagacacatcatccccgtgctgccgggtccccatcttcaggtctaggatacaggggtgcttatattgtgacacgacgttttccagcagcagaaaccctggtcatgccaagttcaggaaggctccgccgacatgaaggccactgcccctacggaggcagttagcatgccttggcggatgcctgggaacacaaagctagctattccttctctttcggctccttacagacaagcccatcgtccctcttaagaattccaagtattagctttgcaggctgctttaataagtccatttatttaaaaaaaaaaaaagtccatttatttaggggagtttatgactatgtgagctttctttttcctttttgctctgaggttgaaatctaaatgcaggcgtgaaatccctggcagaccatgcccaatttacattttatggcagaaaatcataaggctaaaaccttgagtcactgaacgggccagtaccttttgggagaagtaggttgatgttagctttggagatgagttgcaggaatattaatttcagcggagtaattatcctgcaaaagcttcttagggattagggctgcagatgtgtcttagtaaatactgtgaaaccagtcacccgtcttgcaggaaggagcccagcgctgacaaagggggcgtttcaagcctgcatgtactcagaacatggcagcctgaggatgagggaggaatgtctccctcacgggcacttccctgatgggggaaccacccccctcactccgtcagatccataggaagacatcttcagggagaatttggagggataaaagggaggctggggtgtggggaaccgacccatccccctgagcctcccactgcccccacccagcatggcagtcatcattcctatctgcacacacagacctcccagcccagccccctctgctcaggtggcagtgacacagccagtggcctgaccatgggcactgtgttcagctcaatttccagtctgacttccccacactctctaatttttcttttggagagatcagatttcttctaggtcctaggtttgagggcttgtgccttgaagtgtccctcacatcagtctccccacacttccccctcccctggccctgtgtataccccgtctgtctgtctccaccacccgccttcaatcctcccaccctttgataggtggtaggagtgtgagcaaggatacggtgccgcttgttctctgggtactcggtgcacaggcgggtcaggtgggcctgatggcactgcaggccccacgggttaaagctcctcctctcagactggttccctttagcatcttccaccagcgaggagacttgggcattgagttggaactcggacctcaggagcgtcgtggccgggctatgggagacagaagcgaatgataggccagcaatggccagaggactggggaagggtgcccatctctgtgactgggctctccagggttgggccctgacacggactgtccctgcctactctccaggatgcctgcagggcctctgtatgcccctcctgccccattcaggccctgggcaccagatcagtccacactgcagccctggcatggcgtctctcagaaccccagaagaactcattaggaaacgtcatctcctccttagagggctgaggtggtttaaattcacttgtaagtgacctggattactattgtgctattgaggcgacacagcgtggagagagcaaccctccctagaatcagaagactgggggtttaggctgtgagtgtgccatgtcattgttcccttgagacctcaaagtgtcctcaggggtgggaatcctggatccttggtccaccctctctcctgtcctctgcatcttggctttcccatctgtgaaatggagataatctgtacccacttcctgacgctgagccaagaggcttaattagatccgctgagctccttggggaagggaggtactttcattgtattagctcccttttgttttccagaaatgttttataagttcccaggggtccttttcatctgagaaaggtcagctaacattatcagaggttttggagacctctctgggatctcgggtgccttgagctgcctgtgtctctaaggtcccaggggggacttcactgacctctccttttcccttcctgattgctagggaaaggtgatttctgactgccattagccacttttcctttgtgtcaagtcttctgggtttctgcgttgcccccaccctcacaccccaccagagacacttcctggtctcggtgaaacaggtatttaattaaacaaatatgtactgaatgcctgctctacataggactctgtacatgcagcagcttctgaggtaaatacatcagtcctccctctaaaaccacaggaaagaaaatccattccttttctgggtcccattgcacttctagacagagacttcatgtgaatctctcactcccttgtccctactggggagccgttagctttggcgcaggtgggagtggtactggtccctgctggatttctgccatcctgccacatggccctcacctctcctcgagcgagtgtgccagctgccactgggtgagggagtgggcgccaccactgccgctggtggtctgctggagagtctgccatagtgccactgccgccgactccgtggagaccttgaagggcccccggttctccttcagcgggttggccaccaggctgagatggcctcggttgtctttttggaggtgcaccgtgatggtgcctgcagagcacacgagggaggaagggagggggaaaccagatggaatttacctggtggatgtgttgcaagaggtgacatccttttgaattgtagtttaatgtaatgtcactgatcaacccccccaccccttccctaactcttctctcaaggaagagttatggggactgttccagaatgagcccagggccatggaacctgcagaaaatagccttgggctgatctgggcacaggctgcgcttcattgcatctctctgccctttcatgctttggacaaagtcagtcccatacattttgttctcactttctggctcctcagtagtggtaccttccccgtcaaaacagagctgtttccacggggcacaacctggcgtcattggagctggtcctctgtagagaggacccctctgcctcagggtggctgtgagggaagttggggcccatcccattcctccccgttgcctccttcatcatcctttctctcccttccctttccctctctcttcttccaggaagcccacctcagacagccttccaggacctgtgtcaccttcatttagacccccacccctacccctggtctctggctttaacacagatgcctgccatctccttcagctagacacacagcatgtgaatattattaatggaacatggttctttgataggaaacaggagacttgtaggatttctccagctacggtaactcctgactgttggtgtttgtaatggagacacaacagcctgcttcattcgctgcttgtgagagtcagagtgcaagggaacccagtggacaaatgtgctaattgggcttctcctccgggacattggccaggtcacgtaattaggtctggcacgaatgccaatgactccgtggccacccactttggatttcttgctctggtggcacagtctaggagttcccttgtggagtaggcttagcatcagagctaagtgggtgcctggcctcacccaagttctggtggagtcggagttatactcttgctggtggcatgggagacagccacacagatggctttgcaaggactggatctctagacttcttcctgcagctgatgccatgactgttctattggctccttctctcaccaagctaccctccacctgtccccacctttctctgtgcctgcgaggctgaccctgtggagtgtaccagtggcttccttgcccctggtttcccaggggtttggccagtgaaggacattggcaggagatggggtgggcaggagaaaggtagaggtatttatcctactggttcccttggtgctgcagcatgatcctttcctctagggcccccctcttgctgggtcagtaataccgttccctctctgtggccttcgggcctaggggtggtcacagcctttcagtgctgctggcccctctgtgcctcatcagcccccccttgtcctcttaatcctgcatgcactcctatgagccgtccctttgaaaattctcctcatttaaacccctttcaatataccactcattttctgctggcactctgactgagagaagggggggctgcacgtgatcatgtcctctcaagtatttatttcctcccccggccacttggtcactttcctggacatgtggtaatttctgctgcaccagcactcagggcatctgattttcctgcttgtgtccctgccctggctggtcagtgcagacgcttgctttcagggctgctctataattcagcaagtcactcctcaggccatctgtgcctagctcagcggtctctccggtctagtcctgtcatctcagattcctggtgccctaaatttgcagcccaagagtgacattcagttctctctagctccttaaaaagaattctgcttttccttagctcatgtcaggcccctgagtcttgtgaattaataatgatactactaataataccatacgtgaacctggcattttgcggtttccctgaacactggcatgcatccccaggtggagcccaccagaggtgttccgctcatgagaacaggggactgatggcaggtcagagaaagaaccatggtggtagtaatcagtgccaggtgtctgcttctgtgcttttcgtttgttactacctagttctagcaggcctgtgatgcccttgtctgtggtcactgggactcagagagatggaataaggtgcctaaggtcacacagtaggggtggagctcttgagaaggccatgctccacgtgggtatggaagaagggagaagctgtaacacagagctgaggtctttagccttttatcgggagagcagtgtcgtcatgctgtgtttacttgtgggtaggtgaggaacactcctgctgtgtccctatcagatttgttttggccagtctgttccgtgagagtgaacagagaaaccatgatcccagtaccttagagggtcatcagtccagagggctgggagtgccaagaggccccaggacatggtgtttatgtttccattcctagttcctcggcttggagggttgctgtgcttattccctggagagggcctgacccggaagccagcaccaggtcccagagccgacccctccacagtggggaaaggagagcgctctggcttctgtgcttgtccttggggagcttggagcctcccagctgcctggggagcccaggatgtgtgccagacaagggcaaggcccttttgggtcttgtaaaggtcagctcaccatctggtcttccccgcggtgggactatggtatcactcttgccagaaaccactgtctcggggagcccccggcctcaggaggcctccctggaaggacaagaaatgtgaccttcacccacttctctaggctccagctcttgtctgatctcatcagatctgagtgtctaaataaatggaggtgagcagagttgcaaaatagccccaataaaatccaagtcatttctactcctcatattgtcagagctacccagccagactccatggccctgcctccttgcttcgcctttctgcacgcctgtggctctgtgtctctgcctgtccatcttccttgcgtttcccacagccatctccatctcagcccagaccttcctctgaagcccgagacctgtagcagatagctgccttgcagacgacttcaagttgccagcaattcaccaaagcagcatatcagtgggatcaagactccttggggcttggattggtttttggtcaggagtcatgtcggtcctggcccggcttctggcttgctttgtatttccatgggggctgggcctgcagggatgtgggctcccggcactgtgcggcccccgcctgttgagccttgtgagccggtcaccagcccccaggctccccaacctgcagtcttgccagctgagcgcacaggaatgcttacaggcaaaagtgtcgcccagagcatctcagcagtttcgggttggccaagcagcttccctagcctccaggaatgttctgtcctgtacgcatgtatgtatgtatgtatatattattttttttaatttatttttttattggagtgcaatttgctaacatatagcataacacccagtgctcatcccatcaagtgcccccctcagtgcccatcacccagtcaccccaaccctccgcccacctccctttccactaccctttgttcatttcccagttttaggtatctctcatgttttgtcaccctcactgatattttcactcattttctctccttcccctttattccctttcactaattcttatattccccaaatgaatgagaccatataatgtttgtccttctccaattgacttacttcactcagcataataccctccagttccacccacgtcaaagcaaatggtgggtatttgtcgttcttaatggctgagtaatattccattgtatacataaaccacatcatctttatccattcatctttcgatgggcaccgaggctccttccacagtttggctattgtggacattgctgctagaaacattgggatgcaggtgttccggcgtttaactgcatctgtatctttggggtaaatccccagaagtgcaattgctgggttgtagggcaggtctgtttttaactctttgaggaacctccacaccgttttccagagtggctgcaccagttcacattcccaccaacagtgcaagagggttcccctttctccgcatcctctccaacatttgtggtttccagctttgttaattttccccattctcactggtgtgaggtgggatctcattgtggttttgatttgtatttccctgatggcaagtgatgcggagcattttctcatgtgcttgttggccatgtctatgtcttctttggtgaaatttctgttcatgtattttgcccatttcatgattggattgtttgtttctttgctgttgagtttaataagttcttttttttttttttgagtttaataagttctttatagatcttagatactagccctttatctgagaggtcatttgcaaataccttatcccattttgtagattgtcttttagttttgttgactgtttcttttgctgtgcagaaactttttatcttgatgaagtcccgataattcatttttgcttttgtttctcttgccttcatgatgtatcttgcaagaagttgctgtggccaagttcaaaaagggtgttgcctgtgttctcctctaggattttgatggaatcttgtgtcacatttagatttttcatccactgtatttatttttaagctcgtgagagcatctgttcgccggtgtctatagtatgagtctggcttatctgttcaccagacagacttaggagtatgtccttgcatgtccaaagctgacaggtacgctgggaggcagagggatgcagccctgagatgccgttgtgccgaggagcccagcaaaaggcccgggcgtgctcttggcatggggaggctaccctttggagtgacgtccatgccctacattcccgggtgccatcagagcagggcagtgagaagggagaggctgtgctccatggcatacagtgccactacagaaactgcccctctctctagggcccttcccatgggggagaaaaagggaggccccctgtggcagtccccctgacctgaggtcaccaattgagtgactgggcaaatcacatcccctccttcattgggctagatgacccctgagccccggcatccgaggagcccgtctcctgggtaacagtggctggtagagcaggccttgatggccacaagcctacccttgggagccagacctcgaagctctgaatcccacctctgcctctcactggctgcatggcctcaggcaagtcctgtcacctctctgggcctccgtctcctcacctgtgaaatggggatcgtagtagtacctgcctcagagtgttgttgtgaggattgagttgatagtggaaaccatttacagtgtgttctgcactgagtgagcaccgacggttagctgatcccacttttcttatctggtgaaacgagaacctgcgcagcctgagagccctgggagggaccttttcccacctaaaacctgacctcagccacctgcttcaggcatctgagagtgtgagggctctggttctgggcctttctctactgtctccctagatgtgtgtttcattacgtggtgcctggccaacggcaccctgcagatcacgttctggctgctgagtgaatccacgtttctgcaccatggaaacctcatgtttgggagtcactcgagtccgtggaccctgcctcaccctcagcagggctatgtggtctcacctgaggggtgtcctgtggttcccgacccagccccctcccggctcgtgtggaaacaccatcccccaggtgaagccccaggacagaagttgaagcatgttctgtgaccgctgatacgtgcagctgtgatgccttggcttcaattaatctatcaaattagcaggaggtaccagagatgagcccgacctggattgggaggcagagtatagagtaggggtctagacaggagaccagtgcctgagggtgcccgagagtggggctgcactacaccccccaccgtggaggaatgggcacgtgtagacaggacacagggaaggcatcaggatggggtcctggagactaagcagcctcttacatttcccttctttgcctgtgactgccctggcggtctgtctcagctccagagctgtgtccaacaagcgtgaaatgctgcgggcaggagccaccccacgcaagatcctgccacccttttactaggttgagttcggttgtgaaaggacagacgttcattccagtgggcgctctgacaggatgggcagtgacccacagctgatgggcaacactggcctgcggctccagagaccccaggggaggtatgcacagactgcacaccagccgtctgcccctccctctctgtgtgtggtgctcatatacatctatcttgcctcagactctcggaaggtcttggcaagccaggactgaagcagtgcctggggctcaaggcatataaatgaatgaatgaatctcactctgggacatgctgaatacagattcctaggccctgatcccaggggttctggtgcacagatctgcaagggagcctgggaatatgcattttaaacccccccctctcccccccaatcagccttggtcaatcccagcacatactctgagaaacactcatagggctaggccgtgtccttcccggttatcttgatcattgaaatgcaagtgagtttttgactgacttatttggatttcctcatcactttttttgcagatacttagatgacgagcacagaagcttatagtcataacagttaaaaacctttgaaagaggtcttttctctgggcactcatcatcctgttgaggggctggtggctggcagagtcatgccctgaaggctgagtgtggacaaaaagcctggcccatggacgctggccagctgcccagagtgcccctgcctggaggtccacaaatggtggccctccccacccagccttcactcccctgaacccaccttggactcagatccagaacagacactgctctctgcctcattgcccccattttacctggaaggcagcccatggccctggcttggccactatatgaggatgttcccatcccagtttcctcaacatcaggaacatcagttcccatcagtttcctcatcaggtcccagctccttcatgccctgacccaggcctgaggttcctgccacccacttgggtccccagagggagctgaaggaggcctcagcctgccatgtctttcccagccctggtcacaggacccagccgtggcacttccgaagcacagggtggggttggggtgtcattttagtccattctcagttcctcaaagcctggtggcttgagctaatttgtagggatgccaagtggcattagactctgggcctggaggcttgaagagttcagagaaactaggacagggaaggccaactggtctgtgggagaggggcatatctccatggcaactcttacacacgccacagtgcctggggaagcagtgggtgcgtgcacacgagcccagcccagtatggcaggcgcagagccacgtctggctgcctggacactcacctttgtactgtggagtgaatcgcttcatggccagaggcagggattcgtagaacctctgctcctggaagatgaggggcttgcataccgtgtgctcatcgtacttcatcacgctcagatgccctccgacctggtgcaggaagggctctagccgcacgcccactctggcatccccagcatccgtgctgtcctgcacaaccatgtatctatccacaggaagaaggtctggggtagaagaggcagttcccggacaggaggcaaggccgtcagtggtcctcagctttctccttcttggcctttgtcactgtcatagcacagctgtccttctgtctgtgggcccctggaaagcagaggaggaaggtggaaatggtgtgagggagatggtgtactgagaggaacagaaggacccacagttcccagccacgacccaccagtagttgaacgagactcgaaagaggcatctgtcacttctagaataatctgtcctaggaaactggtaaccatgattgcctccaggaagccaggatgagaggtagacttctctaaatactgttctctgccctttgaatttaaatattaaaacattttttaaaaaaaatcaagcagtacacataaccgtaggcatccagagtacacaggttgtcttaactcctcatgttgtgtttcctgcctgccttagggagtattggtcacaggcccaagaagagagcagagtccctgctatccaggcactcagcctcttgcaagggcttagggggtacaggaaagcttcatttttgtacagcacagctgtgcacgtcaatctacatcatggcttcacgacagaattgctgtgtaactttgagaagtgaccaaacctctgcgcctctgtttccccatctgtagaatgaaataataaggatacttcatggacttaggacaaaattaagataaagactgtgaaaaggttagctgagggcccagagctaagtactccataaatgtaatttatcattgttatttctagcattattgccatggtagttatatcttcccaacagctctgggttgaaaggaaggcagactttctcactgccgctttgcacacgagagaagcaaggtctgaaatgccttgaccaggccctggtgcgggccaggagcgaggcaggaggaaagtggaggctgcttgtctctgggccttattctctgctacctgccagagctccccctcctccctaagggcaggcttgctggaacttggggctggaaatgcagcgccgaaagacatcctgactttgtctcaggagagtgccaaggagacagtgtgaggggaggctcttctggccacatttgtcctgtcctgtttgagaggacattcctacaggggtgcccatcactgccgagttattaatactctctcctctgttggactcccagccaaggatgcctccaagctaggcagcactggacatgattaatgccctgaatgaccttcagttcagaccgtcggcatggccagctggctccatgcatggagtgcctatcaatttgttcaggaccccagctcagagagcttcctgccacccacctgtacctctggcaccaggtggcgctgaaaacctcagcctggcccatttattaccccctcaccccctaggggtgtctctctctttctctctctctttctcacattagctactgtcttttgggccacagagtgcctgcccctttaggaagggagaggtgttttgcctggtatgtgcatttgctttgctggatgtaggatgaggcttctaagagctgcctgtatggctggagcatgatgggggaggttagggttgctgggccaggtattaggggttcagggagcctgaggcctgatggtaaggggctgtgctgacaccacagcctaggcctaccctgggtctgctctcagactgtaaagaaggagccccactcgagcctgttccatgagctgagaagccagtaggaggcatctcgatgcagatgcaaatcagaaattggctcagggataagttgatatatgacaagatagcacaactgcttggcaaacccagccctacttgcaaatttggtgaaggcaagaaagaagaaagaagagaaaaccaaggtggcccaacaccaaccaaccaggcctggccttgccaaggcagcccagctgtgccgatgtgtccaggtggtatcccaggcgagccctcatgctcccatgccagcagcccaccaccctccctccccacactcctctctccctaaggagcccttaggagatcagtgtcaccttgcagtggtggtgtgggagaggaaatagcaataattggtaataaagtcagagagcttgctgggtgccaggcaatgttctaggtgtgttgtatagatcaactcctttaaccttcacaactaccccatgaggtagtattatcagcctgtttcagagattgggaaaacgagaggttaaataacttgcctactgcctcccgccagtaaggagggagcagggatttgaacccagacacttgtgccccatagcacacttacccaccatgcagcaggggggttgagggctactgtgtattcactttgaaagtcagaaaattgaccccaaggagactggaacttggccaaagtcacctgtaagtcactggctctgctgggacaggacacaggtttcctttcccccaggcctgcctcttctccaacctgatggagtaagtgcatgtcccagtggtgggtgggctccgcacctctatagaaaccatcgtggcaggtcaatgcagggctggggcttggtgttgacttttttgggactctttggctaggggtttcaacaagacccaagaggcactgtcattcccagatgttctcaggagccctgcctgaaccttcttagagagcagagagcaagccaggggcatccaagcagcccatggcacaacagtgcaaacttagggtgagttgatagtgatggggtatctgttgggtagtcagcctatacttctaaaactctagatttggggcacctgcctggctcagtcaatagagcatgtgactcgatcttgggattgtgtgtttgagcctcgtgttagacatagagcttattttttaaaaaatgttaaaaaaaaatctagactcaacaggtagggaaactggggctcttcctctcacgcgtcatctgaaggtataggtgaagcgatatctgagggtcctcctactcctgagctgtatggtttgtggttctgacacaggttggtgggaagggtagaggaggattagggcggtggcctcagcccctgagctaggcaggtgggtttgctgctgctcagggaggcactctgtggcttcccattggcactaatgctgaccttccattcccgaggaagcttgaggttgttctctgtcaccatctttgttgtgcaacctcccattctctggaatgagttagggaagacctccattcttcccagtcctccctcagaagtcccaagtaaataattcaagctgacaggtctttctcaacccagaccttccctttgctacatgcaggtacgtctgttatatgcatgggccgtggcctttgatcagtgctctgtttcctcagagcactgtgcagggagtcaggagcccagatctgttgcaggcattcccactagcctcatgaggcccctaggatgaactcctaatgttcatctgagtcttgatttcccacccactgccatagccttgtcatgatactcagatgacaaaatgcacagaattcctttgtgaagtcctcttcccaagtgtctctgccaccgaggcttgtcactgcgtgggttattctcaggactgactcagctagggtgctgggaggcaggtgaggcacccgcttgagacaggaccttccgctccctctgacacactcactgagtacactgggctcccttcagtgtgtcagagggagacaaatgtcctttctccagcccacacttccccctgtagccccacagccggcccctcacccagcatcccaccctagtgttcttggggagggagaaataggagacagggagggagggtgggcagggagggagatgccccaagccagaagagttcagctgagagccccctccccaggagtagtgaacaaatgacctcaggtccctgtgtcctcttctgtcactgggttgtgtcctgaatgaaaaactctgggctcactccaggagactcaagggctaaaatccctgatgggccccactgtccagctggtgattaaatgagcccctcctcccccgccccgccgtggggctgcctcggtcattgcagccccttgggacctgagtgacagccagcctgccacagggttgcaggacactccctagactgaaaggagggtcatggacagcagggcctgggtttgtatttggcttccagagtggggacagatgacaataccagtgatgccagacacagggacagaggccaccagcaggctgaggggaatgagtgcctcgtggctcatcactaccagttggcacattttatttcctgagagtctgtgtatataatctctgctgcatgctaaacccgggttcattaaaaattacagaagctctgcccctttttaagcctgccgttcccattgtagggaagatggcaggcaagaccacaaatcaaacttgtaccagttcaaacttagacgaaattcgtcatgaactgtatcttatgagagcctgtcagctccttatatctggagacaagctggctgactgtggtcattgtcagcgctgttcacaaatagtctgtttttttcctgtgggaatgtggtatgattgcgcttcccttgccctttgaaggtaagtgcagccacgtgatttgcttctgccgacatgatgtgcatggtagtgacagatgtcatttccagtgggaactttaagggcaagtcattgcccatgtcctctctctctggcccatctcagaagcaccatcactccctgagtgactgactatacatgttggatatgtagcctgacagagaaatacatctctgtgctagtaggcccctgtgatttgggggtggtttgttatgcagcacagcctcatgcttcctgaccagtgcaccagctcacagccagattcctatcatggagccaggaagtggaaagtgacctcacttgaaccaggcagtcagatacttcatgcccaaatatatcctatataatagtagattctcctatgaagcatctcctgtggatcactggctttatagtcactatcaccatttctgaagagaatcactctcaggtggggaacctgagggtctgagacgttgaagaccttgtgcacagttagaggagctactgagcactctagctgggattcaagactgtctactctaaaggcctcagggctgggatcctgtctgaggccctcttcatgctgtgtgcctcagtggcctacatcagacatgagagccttccaggagctcatacccagctgggcagtgcactgctggtggagggtctgatggggtgctcggcactgtggatttgcagggccaggggcaaagggctgctgcctgagggacggtctagagcctcccaaagccacaccgccacaagcatcatctttagaccagaacagttatactcttggagcatgataacctctcaaatgtatatgaacactttggagattaccaaaatacagattcatttaaaggcactatttgagttcctagtagtttttatcatcattttctcaatcagtggatactaaaagtataatgattatcgcaggaggactcgtagggaacaaattatgttgaaatggagtcctagttgaaaaggtttaggagaggtactgctgtcatctgtgacaggcatggtgtcacacttccaggatagggtctgagcagggggagatgccagctgtgcctgtgtctgggggaggctgaaaagggcctgtctcaggagaagaggggacgcaggaagcaatagggaagtggccagggctggccaggagaccagagggagggctgtgagtggcagtaaccctggcttgctttacttgctggcctagaggggtggagagaaggcctggccacccagcccaggggagcgcctgtctggtcctgctcaggccaaggaggagggggttgcctgagaaggtgaggtgaggaagccttcaggattgcattccaataaatctggcggggcaggaagtgttttgggaagagataattaagaaacagcttggggcagccccggtggcggtggcgcagcggtttagcaccgcctgcagcccggggtgtgatcctggagaccggggatggagtcccacaccagactccctgcatggagcctgcttctccctctgcctgtgtctctgcctctctcttcactttctctgaatgaataaataaataaatctttaaaaagaaagaaagaaacagcttgtatcaaaagaagactgcagtataagatgtgtcaggctgcagattcaaaagcagcatggtttatggcctgccctctctactctgaagctctactgtacatttcgtaggcctgctggagccagagatttgatacaagtacctttcaatgtctttgtgatgcccaagggagcattttttaatctattagagaagagaggacctgaaaaccatttaaaactgcttaggttgtaatgggcaagaggattttgagtttctcatgtggcagagggttgtgtatcatctggggccatccaggctgggaaagcacaagattattttctgggggaaaaagccatgttttaaaatccactctaaaaatgactcaagggctgtaggatggcgtgccctccatctgtgtggtcctctacccaatgggatcaataccgaacactgggggacttcacacatcaccttctcagccatggctgaaatatgtggctttgcggagcatctgttccccagggaaggcctgatagccagaaccacagagaaatgcttcatattcctctgtcacacaaacttatttcagggctgattttatcctttgagagaagtttttttcctctccttttcctttaacatgtaaaatctcccaatgttcctccagtttgaggaccaaatgcgattttaatatagcgattattagtttagaagcccttcagccactgacaaatgtccttagcagcagcagcagcaatgttctgagcttgctgtcagggtgggagacgcatggggcaaagatgactcaagaatcccagtgccactggaagggctactccgggggtggctaaggctggaggcttcttcctccctcacccctatggtatcttaacctcgtgacagcatcatgggccctcgggtaccttgggcatggttactgatggctctagcagcattccctaattcccttaggacctgaccccctagaagctgcatctgggatcttggaggctgcttaccacccagacaggcacatttcccaacctccgacacccttccccaggcctctacacctttctctaagtactgtgatcagcagccacctgccttacataagaggcctttgagctagacaggaggttttgtcagtggttagcatggcaactttatggctgcaagaagaaacatccttttaaggttaaaatgtagcaatgggtggagcaagcgtgtgagcgtgcagacgaatgtgtaagtgcatgtgttcgtgagagcgagaggtcctgatgctgcaagaccaccgggtggaaccggcccagtccgccgagccagcctgttcagggagagcgcgagcgggcctttccccagcagagggcagcagcagacatgccagcccaaactccacagccagcccacccgccctggccctctgccaggtcacacattctggacctggacttgctgggcctgtcctcagagagcccagaagggcggctgagaggcccctgcctttcccaggggcagtttttcaagagctcaggagttaccttcaaggtcgatgtccttccacgttccggtctcctctcacttcaccctactttttctcaggggtgtctggttgcaggggagcttcctgcccttgatgaggcgtgttctgaggagtggggtgcctggctccattcagagggtgagggcccccaaagctggtgatatggcttgccaaagaggggtttgcgcgtaggagctagagggcatatcccagctgagaggaacgtggtcctcagcagcaccctgggagggtcccaggggcctcaggccctttgcagtggaggagcttctcagatcctcgataaggagctggctttagggagtacggcacaggaagggactaggagacctggccctgcctcagattccctgtccctttctttctgggcctcagttgcttgttctatactgagaggtgtctgactcagccagattctcactcctgtgggatgactggccctttcatttagcaggtcagtgtggtgatgggtaggcggggcgggggtggggggttggcagggacactttcagattggggacttaaaagacatacagacccacataccttgattgtatcctggtccaaacaaagcaataaaaaacacccagggggccatcggggaaatatgaatatgaactccacgtggacattcttcgggaggtgttcattttgtcagtgggataatggccatcggggttgtgtaagaacctcctgaggtacttcagggggaatgctctgatgtccaaaaattgcttcaagtactttatccttagggtagtcaatgaagcagatatggtaaaggtcacacaaccatgtgaatcctggggtaggatatgcaagaattcattatatatcattccccctgctgtttcctgtaggcttaaagtttttcatggtaaaaaggttaaattataaactggtagctttaaaaatctgtagaagcctgggccctgccccaggggatccgaatctctggagggggaacctgggatggatgtttttagatcccctggaggtcctgaggaccatgacaggctcagacaggttcaggtctcagatttactgaggtcaagaagagtccatggggaggtgctccccaaaactgtgccaccaccccaggcaggggccctcggcagtccccatggtcaacccgcactccacgggggcacccgatacccaggccataggcccactgcccacaggctgaggtcatcctggcttcgtgcacccctcccccgccatggagggtggggctgccgggacaggacacactgtccctggagcccagggggtgctgcctgcttctccccagacagctgcctctgtgaagggttaaacggtgggaatcattggctcccacccctgtacctgccacccagcttcctctgcaggcccagcttgcggaacccaccctgcctacgtgcaggagcccaggttaaagactcctggacagcctaggaaggctgggatgagtgactccaagggcagggcacagagatgagagacaagcaaacaacagaatttctgctgtgagccaacccagcagcacccccacatacacagttgtatagacgcgcataaatgagcaggctggcacctccatggggtagaccccttgttgggggtggggggctgtcctgtcctgggtggaccctcactcccacaccgccaagagctccacgaggccctccccaccctatccactgaggcagcactcaccagggcctccttcctggaagcacagcagggagtgtgtggaagagaaggtccagtggaagagaatctccttcggtggctgccgactgctggccctgagcagaggcctttcccggcgccccagcacagagagctcactgtccactatggcgctggtggagaggtctgcctagacccaggtccgcccagcgggcctgggatgggaggtcacctgacccttgggaagggctggcaggggatgacgcgtccagctgtcagctggtgtatggctgctccgagcaggggagcagggcctgcggcctaggagggcatgtgaatgaggaggaggaagaggaggagaggcctgagagggagaagccttatgctctgctgcctggttggaggtcaggccctgtgcaccagggccaattgcatgaggtccccagtggttttttgattccttgaggtaaggctaggctagggagtcttttttccctcccttcaccctcttccccacaactttactgtcagcttgccccaagctgtcactccggcgagagggaaatcaggcaggaaaacagcaagccagtcagcactccatcagcttgaaaacaatcagtcaaatagtttttgaggcctttgctgggctgccccaggaacctgccagaccagggactgttgtcaggagatcacagagcaggtgttggaaagggtattcagcaggttgaagggcaattccagtgtatttggtatgcgaacatggagcttagggggggccccttgcccagcctggggggagcagggaaggcatcctgggggaagtaaccattggataaataggatcatccgggttggggtggagagggtggtgggaagaacatgctcgctaagggaagagcacatgcaaaagcccagaggcagcagggaacagggtgatctgggagttggaggcttttggagcatgcaggatgtggagagtgacgacagatgaggctggggtgggggaagtgcaccttacaggtctctaaccttggcttctcaggagaaactgaagggcattacatcaggaagggccaggcccaggttggcgttttgagcagagtggatgctttgaggagagtaggtgagggaggcatgatcaaaaatgggcaggcaggttacgaggctgccaggttctgctctccagctgagttcagcctggtggggagaggaggcagtgaggtggaagggagtgggtgagttcctgagatgttcaggaggcaggcttgacaaggtctagtgatgtggagatggggagagatggagtgtgggaaaaggacagagacttgtcagggacaggcttcaggtctcagcgactctgggccaagtattaggtctgaagttggcccttcaggcaactcaagctaccctgggcttctggctgtagttccctcgggcactgtgtgccccacttgcctggggtgctagcctaccccttcccgggcttccctggctgtggacactcagcccctgcggctcagcagcagccagggggctcagcctcctctctggccagaggctcctccgaggccccctcaggccaacttgcctcttggtctggtccagcctctctctgactctgggtcacagcccccaggtttttgcttccctcaggatgccctcacctgtctcctggctctaacagggctcccctagatttgtcgctgcagcagagccgtgatggcttttccatcccctcaacccccgtctccacatgtccacggagggctccttcctacggtctagccaccctcactgttcatgcgcagaacagatgagccctgggcttggataaaggccgaaatgggagaccaggcaggactggaacgcaggcctcctggcccttgtcccagaggtccctccgtcactgtgctgtgtgctttgcactcttctgggacctcgcatatcaccagctgcccagcagacatgttagcagcaaagaacagtgtcacgggaaggccacagcaagtttgggggctgcccgcagctgcccttcctgtggccagcctcctttccagtcctctccacacccagccagggcagagccctgctggcatgacagggattcctgggcaccatgaggctgggtgtaatgggctgagcatccatggccctgctcgctccccagggcagtggatcacatttcactggggaaggcagatggtcaggctgccttgcgagcctgctgagtacttggttgctcagctgcccagctatgtgctgcgctccagttacctggccctggaagagacggtgtgacctcctttccccccaccactcccccatgtcccctttcccacctgctggactcctatccctgttctgggaaactctgaattaacatgggttgagctgtaggctcttaagggtagataggaagggacctcccacctgagccatttggccattgcaggactgaacccagggcctcaggagggtgggaccacattccagtacttgctttctggtttcgttttgttgctgttgcaaagagcaaagttccacactgacttcctatccctccctttatttaacatcatttttgagcccctaccatgtgatccaagacacacagcaatagacaaaatgcacagggccctgtggtcacagagccagtgatctggtgctttccatcatgcaatcaaatgagccactttatttctgtttcccgactatggccaagttctcttcatcgttgtttttccaaagctcagctttacctgcaacataacctgcagctaagcctcctccggccatgtctgggaccagctctgccccatgacaactccccggctcaccctctgggcctgatcctgcctctcctctacaaagtcagtcctgacccatgaggctcatccctggacatgacattcccagccagctcatggatgccatttgaaggcagaagatgcctgggcttataagcacacagccacctgtttgggagccgccctgctcactcaaggcaaaggggtactcccctttcaccaccccacccacccaactgaccttttataggaccaccccccttgccacattccctggcagtttatccatcactacatcctgtgaatttcaagtcccaaactggactcccttctctccatctctatggctactaccctggcccatcacggtgtcatggcttcagtggtagggctcctcacagtgtccccccttctcatcacacccttgctcctacaatccatcctccccagagtgatgctttgagacaactcaggttatgttgcttacctgctgaataatcttcagtggctccccatccttagaataaagtccagagccctccctgaggcccagccctgcccaccttcctagccctatctccaggggcacccccttgccttctgtggtctagccatactatgtgtggatcctttgcacctgctgtcccttctacctagaatgcccttccctcacctctctgcctggttaactcctctacacactttaaaagctagctcaaatgtcacctcctccaagaagccctccctgacctctctgacatggtctgctacccaagaccttgctttagaagcacttatcccagatatagtcatgcttttacttgtgtgattatttgctccctgtgtgttttcctcccatgagggcagcaacctggattgttttgcttaacattgtgtccccagcatgtagcatagtgctggcttcctggtgcccgtttggtgaatgaatgaacaaacatatgaactcattctgggtctgcgacttcccattctggcctcctgatgccctggccttcacagctgggggtgcatgggtcaggagctggtatcagggagttctttttctcttcctggcctcgggtgtggaggccccgcctggtgactgtggcctgtgacaccctccctctcccccctctactgcccccatgacccagttttcccgctctagagacaacaacaacatgttccaggacatgtcatcaccccctgctcatggcataaacatcgtggctgtggtgactgctgctaacccacccagcctccagcagaagcccctgctgccctgcgctgggcctctcctgctgcaccccagcgtggcacgccaccctcccctgcctgctcctcttccgctctgtgcgaggagccccatttcataggccaggatgctgaggctcagagaggggaagcaccttgatcttgtggttccctccacaatctcttttcttcctctttttcctgcctgtggattatttcctgtgctgccctggctttttctctcacattctcttgtcaccttgtctgtttctgcgggtactgctgttctcactctgctgtgctcaggccacatgtgggtgtgtgagcaccacgaggagatagagcacattgggctgaacaaataagttctcattagggggcttctgggggtgtgtgctctggggagaacaggggtatgagattctgcccagagactcgggtgctgggggacctcacgcaggccctgggtacctctaagggaatcctagagcaaggctgcaggggtggagcccctcggcttccttcatggttgacgcagtgatttcacctgccctccagctgtccagagcctccctggaaggcggttacctgtgccctgtgggggtcagctgcctcctacatcagctgtcaccccattccctggaaagcccaggacagagcgacctcactgtgcagccccccgtagtctgtccgaggaggcgtgaagactggtgtctggctacttgcagaagacggagtacatgctggcctgacccagtgcccagctcctggccccacccgcgaacttctagcctgggcattgggctcccatcccagagcctgcttggacttgtattgggctcccaagtggctggtgagctaagacccctcagggcagagtggcgcaggccacggcaatgccagccaggcgctagagggttagggcgctggctcagagttgttgggggctctgagggagtcagaacagccaccttcagggttatcattccgcaggggcagcaaacattcacatatttggtggccccgtttttctcttctgacagacacatgtgcacgcacgcgcgcgtgcacacacacacacacacacacacacacacacaacctcgtttaattctcataagagccccatgagggagggccttttattacttttgttttccagctgagaaatgcagcctcagagaggccgtaggtcacacagctgtaacagtggcacatagtggcagagctaggatttgaacccagagcccccactcctaacgactattttatttcccgggcagccccataggtgcacttggttgcaaggacacagcccaacaccaaggggagaagcacaaggtgatccctccactcccccagtcaagcccatgggccagctatagggaggggaggcctctggagggaggtgtcagcttgtctgtgagtgtggacacagctggggaactgggcccaggcctggtgtgccctgcagcacggggttactggctgtgtccccctgcccacatctggctgaggcacaaagggttccttccccacacagctcttgggagaggcagctggtgtgtggcacagattgcccagctacaggcgattggttctgctgggtgtggttcctctgccctgaacagtcgtggtcccatttagcagccgccatcaaaggccatcagagaaaggacctgccctgcctgagaatgcccagagcactttgccaccattgctagattcaggagctgccctccttgagaggatgggctgccacctgccttcctggcccatgggaggagccctggcagtgccctgccccagagcaaaccccaggggatgagcctaccatcccagctgtgttggttcaccagtgtggccgcagcaggtgctttccagaaagaaatagaatcccagaagatcagggctggaaggtccccccaaggccacccattacaatcttttcattttactgcaggagagggacaaggagaggccgcagagagatgcccgggtcgcacagaggccagtgaagagctacacctgaacccgagtcctgagactgctggttctgtgggcctcctggggagagggccggcaaagagcctggcctgtggtgtggacgcacccaggtctgagtcccagccccaccatttcccggggatgtgagcttgggccagcatcctaaactcactgagtctctgtttcctcatctgtaaagccaggatagttttcttagggtggttgtgatggtgtaatgacataatgcaggtgagaaccatttagcacagtgtgacaccaggcctccaaggtcctggctaattgtatgaatggctataattatagatggctggcaagtcctcatgcggacggcactcagggaggcggactgtgtacctacccttcccaaccctgaattgagattcgtgccctgacatggttatggggacatcggcccagaatatttgatcctgggactggctcccaaatcagaacccgtatgtaccacagaggcacacagggtgctgtgggagcctgaggagggagacgttaatacacttgccatgggggcagatgtcaggcctcccaggggagctggcatccaagctgggccttatggggtgctagaggccccaggctgagaagtgactgaagggaacaggaaggggaacagcatccacaaaggcatgcaggctggaagagcagggcatttctggaagcctggagcagaggtgcctggaatggaggtgggggtacaggcaggtagagaggacaccttgtcttgcctttgactgtgcctacattctgactgtgaagccaggcccatagcctcttagaagggcaacacttaacgactcacacagactgttcagtcatctcacagattggagggaccagaggcctgcaggatgaagcggccccccagagatacacgatggggcaactagagccaggaagggcccccatcagccagctctcaggcgagggcttgacattctgaggtgggccgtgggagctggggtggattgatttggggcaggggacacacgtggcgatggtcctgcacttgcaggagagtctggcctgggccagtgagagatgcacccggatgacagactggggggacagtggctgatgcgggttatttatggctgtttttctgtgagtccttcagggccgcagaggtaattgaataagtgagcatgagcaaactcgagcaatcatttaattgtgacagaaaatgaagttggttgcagctggggggcaccagcccattaccgctggccctggtttctgctgagttgggcaggcagggctggagtggccatccgtccttggtctgccctcaccctgtcgccccgcagccgtccccacgcaggcagggcctgggggcgttggcggtcagggagtttattttcccggtaggcctctccccgagtccccttctctgccccaggctgccgtagacagtggggggctgggaggtcctcagagctctgggggaggcttttggcttgggggtgagagaaggggctcaaatcttgaggtttggaacggcaatgtcagcagatgcacaggaagctgagatggaagcaccattaacatccccatttcacggatgagggaactgaggcactgactcctcacaagatgcgcttctcctagagaagcccctgggaggcactgagatcctggggggacagcaatgatgcaggtgagatgcagtgaggtcatatggatcccacaagtcctgcaagctttctctctcacctctttttcagcccagctggccacccactgcctgttcccccaggaaagatgaggttggaagcctggcccccaggttctggggctgaaggaaactgttggagccctggacgggcttagcccccaaagctctggcctctggccttgcatcctctggcatccagtccagcccttctgaagaagcagataaaattaggcctgcaacgtgagaagccagttcaccttcccaggctggagcagccacagtggccgtcgggcagtgctgggatgacaggcagccccccgctccctggcagtggagcaggggtggggttaggcctagacccaaactgcagctgacctcgggcaagttcctgggatgctgcattttatctaataacactaactgcagctctgagcctgttttcttcccagtgaagcaagtgaatgctccctgccactctcactgggtgatactgttgtaaggagctggagagacatcaagaagggctcctctttctttctttctctttctttctttctttctttctttctttctttctttctttctttctttcattcattcattcattcattcagctatgggacacctgctatgtaccacccatgaaatctatttgatttttaaaatgatgaccctgtgttatttttgtaaaacttaaacttactttaaaaagaaggggagggggatccctgggtggcgcagcggtttagcgcctgcctttggcccagggcgcgatcctagagacccgggatcgaatcccacatcgggctcccggtgcatggggcctgcttctccctctgcctatgtctctgcctctctctctctctctctctgtgactatcataaataaataaaaattaaaaaaaaaaggggagggtattttaccactattagaaaaaagaaggaaaggaagaggagttcagtatagtggcccagtgcaccaaagtggacccccccaccttgcctggctgaagcccacaaagaaatacctgtggtgcagagggtctgtgcaggtggacagcactgagcactccgagaggtcaggaggcgtgtcgtgggaggtccgaggcacctgattattatgagaaactcacactcgataatgggttaatctgatgggtcaatcgctgtgcttctcggatgtcacagaggactttagcagcttcctgcaaactcgggctgcaagctttgaccctaaaccagaaagcaactcctggcgtggtgcagtgggaagcaaccaccctggagaggtgttgggaggggacggaggtgtctttagagctggcccttggccaaggctgagcagcaggcagagtaaatcctgggaaacccacccccactgcttcactctccattggcctccctaccagtgtttcttcacgaggatgctatgtattctctctttcctttcctttgacaaagctatttgtaggtggggctctgataggtttgcatttttaaaaaggacaaagtgttcagctaaaagaatgaatctttaatggtggaatttcagacctcttcctcttaggagaggttttatttgttttggttttgtcagggactcttccctgtgtctctggagccacgctgccatcccaggctccctcctagacactgttggtcaagtccctttctccatcacttgccagagcattttggggggtgggggtggggaacaacagcatcctctggttccaaaatgagcccccagccagggcaaatgcactctctgctcttgcattcagccgtgctctgccctggcacaccttccccagagagaggtgggggggcctctgggagccaggagtgacctgcacccccccgccccaccatggggctgggcagaggaccccagccacatctgagtccagctggcagcattatgcaatgtcagctcctacctggactagctcctctgacctcagcacaagtgaaggaatgaacccctcacacaccctctgtcccaggtgggggaggcgttaggcaccagctgcagggacctatcaggctcttcccctcttgcccgccccttgcctcactctaccccttttctcccagagcagccttatcacagaccctgctcttcagttctggaggggaaagagggacaagcgcagtctttttcttattattatcattaaaagattgattgatttggtgggaggaggggcagagggagaggaagagaaaatcccaagcagactctccactgagcatgagccagggcttgatctcacaacctggagatcatgacctgagccaaaatccagaattcggtcgtagaattcggtcatgatcctcccaggcaccccgagaagcgccctctttagggatctggctgtagcagccagttcaggatctggggagatagttgaggccctggcctgccctgccctgcctcagcctcagtgtccgggctctgagaagcccccagtggagccgagggagggctctgccctggcgtgggggtgccatggaccttgccagcccccactgcggagatcaggagggaagaaggccttgtccctcggaccgagtgctaaggagcctggggtgcagacagcttggtgagcaagtcccagctctggccccaagtgacccttctgaagaccttacctagggcttcgatcctggggtgccagcaccctgccccgtcctccccagtctgcccagaccccacaaacacacactgcccagctgcactgtgcgttcagcctcagggctcctcgttggaaatctcagagctccccttcccatcaccccagcccaggctgctgggtgtaaggactctgacctgaccctgcaggacacaccacagcctgcgccagatcctgtggatcctgtttgcctggaagcaaggcagcctggtccagttgtcactgctgtccccagcgctggggttggggaaggggaggggaggttgactggtcacacctcccttctgacctgctgcgttgctgacccctgctggccatctccacacacacccctccccgcacaggcatctctccacagagccctggtgcttgaatgcttccagggccagggagctcaccacctcatgcagcatacagtagcctcttccaggtggaggtgctctgcttcttaggaaggttctttgtattcgctgaagtctcaatactggtgactgccatctgtttacttacagtcattaccctctggagtagattttcatcatcatcatcatcatgtactatctatgtgccaggctcagtacaacatgccatttaaccctttcaacacctgtgaggctggtgcctgtgtcatccccattatatagatgggaaacctgaggtccagaggaaacgtgttgcctaagtgtgtctcaaagccaagaagtcacagaacctgggtttcaaatccagagcccatgcccttgccagctagggatgtccccatctcaccgcccccccccaccccttctgcttggctctggcttattctttcttttctaccaagccctgctgtcccacataagctcccaccttccccccagaatctgcagtggattcactcctcctccaggaagcccttctggacagctaaagggtaaggaaagagctttcttccccaagtatcttttcagagtgagaggagaggagtggaggacataaggagcccacatctatgatgtgggtgaatccttggtaacacagtggcggtggggggaggggtctgttccttctgctcctctcccctccagactagattttggtcaaggacctgatgctcctacttggtgcctgtcaggacctcaggagtcagcatttgtggggtctgcgctggcctagtctcatgctgaccattggcaggatggcagcatctgtagcattgggggtggcatcttcctgcaggcctgtggccccaccctgcctggtacaccagcttctgtggggggatcaggagtgcttgagggcagagctgggggtacaaacttcattgcccctcaaagggcaaggagcaggaagggggcccagagaggctttatggttcaggccagcccctgcagggcaagaaactgcatgggtgtgggggggggcgggggggacccaggacactctggttaccaggggtctgggatctcccgcttccttcagtgacctccggccaccttccgtagccacaatgccctcagtcatgctcaggtaccctcatccctggctgtcaccttaagctccttccattttgcagtctaactgttgagacctcagggagcaggcctgcattcagaaggattgccatggatgaaaatctctatcaggcttgaaccaaaagcatctcagtgtagggcaagactttcagacccacctagtcccatccattcattctgtgctagcctctctgctgagtgccaaggcagcctctgcttacatgcttccaatgacatgaggctcactaccttttgaggcagcctaaggctcaaaatagtggggaccgtctttctcctgcagagctgagagctgagttcacaaaggctcagaatccccctagcccttcccctgatgaagtttggagcaactgaccatcttattgccgcatcttctccccagccaaagtgaagagaagaggcctgctctgagaattggggcggggggggggggcgcctgccacaggggagaggcatctcacacccaaccctcagctgagctgctgaaactccaagcccagccctgccagctttgggtggagagtggagagagttttgacagaacccacatatgcccacccaactttggggttctcagaggttcaggcctgactcttggtggcacacgtttgaagggagaggctgccctaggggtgtcctggctattggaaaggagagagagggacacctgggtggctcagtcagttaagtgtctgccttcagcttaggttatgatcccagggtcgtgggagagagccctgtgtcgggctccttgcttctccctctgcccctcctatgttttcctatggccccttctgcccgcttatgctctctctcaaataaataaaactcataaaaaagaaaagaaaaggaaagaaaggcgagatggacatgggggcctgattcccaggtggatggcacagaaggaggccaggcttgagctgcctgaaaggcccctgcccaacaggacagcctgaccatcctggaattcagactcaggttctctggctccctagtccccgctgccctcctcagcctggatgctatacttttttttttttttaagattttatttatttatttattcatgatagacacacacagagagagagagagagagagagagagaggcagagacaggcagagggagaagcaggctccatgcagggagcccgacatgggactcgatcccaggattccaggatcatgccctgggataaaggcaggcgcttaagccgctgagccacccaggctgcccatggatgctatacttttactgatgcagccacagaccccccaccctcacccctgttgctgcctatagaactgaccatcatcacgagccccccaaaccctcactggagttcagtccccgccccacaggtctgcgcagtcaggcctgtggccctgcgtgcagtagtgttacctccttcctccagtgagtcactgttcctcccccattcctctgcacgtggagacggggcacaaatagataaataaaacgaaataaacacgttcgtccctgttaagtttcatcttgttagatccaccccattgctccggcctgtcagcttctatttagatcccagctctgtcatctggtgtatttgccatcatctccccctcccccagctctgtggcatctgcaaatttgataaagtacacggagcatgtttgtctcagaggaagtcccctcctccctgcattgggtggctggagcacaggtgtgcgcaggcgtgtgtgtgtgtacacacacacacacacacacacacacacagctttcctcttccatttttggcagaggcttgtcagccctgtcgagtcacttggatcctggtggggaccctgggcacccgtgttccacagagggtttggccctcagcagccacttgctgtgtacgtgtccctgtgaggacgggatgctctgggtacatccacacatcctcacctccgttggctgctatttaaagagcctctgaccaggcaatgcctcactggccctttccaccgcgctcgaggcatggctggccagccagcatgggccttgggtctcccggacagctgcgtctcacctcccatgctgctagacacacaaggcacagcgcctggatgtgtagctcatcctccttttggtcgtggctgttgatagtggagtcagcacgactgcatggggtgagaactcctccttgcccatgcacctgctgcgtgctgtttctctgatccttctcttcaggggaccccagctcttctctttgcagtaattgcatagcgaggatagccagcttggaaagatccagatctttactgcagagcctgccagacatcatcttagtggaatggaaaagaactcagggcctagacagaccttccagaatcttctagtccattccccagcctccaggcactgcatattggaacacagaggacttgggcatattcctattgctcccctcctgcaatgggagctgtttgttcttcccgcagggaaggtggcaaaagctggttacctgcatcaggtagctgatggtggtaacaaaccaccccaggttcttggtagtggcttctaccaacattcattgatttcttgctccttctactacactgcaggtcagcaggggatttggtctaagccatcatcacctgggacccaggctgagggcctgccccagctgtagcatcaccccgtggccgaaggaggaggtcacagatcccgtaccagctcctagcggccctgcctccatgtgtcatttgttgcttccattcagcatttcactggccaagcaagtcctgtggctaggcctgatttcaaaggggaagaggcaatctcatctctttggtgccaggaatcctggcgaatggactctgcatactggctgctcctgtcccccatcgtggtcccgagttcccgtcgtaccgtgtgggtgcgcattctctgagtctagggtggaatgtcttccactctaccccaaaagcctgtgtaatacacacttctgggggattttgttcacatctggacctgttatccatatgagcaacagaccaccccaaaacttagtggtttcatgtgacaaaattccatagaactacacccacccacccacccccccacacacacaagaagtgccttaatgaggtctgggtctgagttagtgtatcaggatcaatttcctggttttgacacgatgccacagttatgtggggtattattcttggggggagctgggtgaaggatacatgagaagtctttgggctatttttgcatcttcttgtggatcttagactatttcaaattaaaaagttataatagtaatacagagttagtggctgaacacagcaacagtgcagtgactcatgactgccatttgggcagtgctgggtgggaacagcttatccctgctcacgtgggactggcaagagtggcttcactcatgcgtctggcgtgccaactgggctgctggaacagctggggacaggcaggcatctgtccccacaaagtctctccagcagggcagctgggcactttacatggtggctctgagcccaaggggtgcaaagcagaaacgagcaggcctgggctggctccggccagcatccctctgaccattgccctgtggtcaaagcagtcgcagaatcagcccagatccaaaggaggaagaggcagatgccgcctcctgatgggagggtggcagagcatgtgtggcatcttcagctcactgctgtgtcagaggcttctcgatttgccaccctggctccagtccaagtccctcacctgtgccgtggtgggtggaggctggagaagtgaatggaaggaactggcatcagccctgccgagagagagtgctccagagagtgccccagactccggggcagtgctggactcccacccagggctcagcccatttcaccccttcgaagcccctactcccgcccccttggcagcagcgggacgcactttcccagcccagcccggcctgctggggagtctgttttgcacatgctggtgtttgcaatcaaaaagttcagcggcccttccagtctgcttaaattagtccccgtgaaaaccaaatcatttcatttgcagagaagggcttaattgcaaggggaaggaggcaaagggaattctgttgcctgttttcattgaagaaaattgctgtactttcccctgtctccttccttaaacagaagcggctcagaaattgggctgtaatcaccagtgatacctctgctccctttcttctcagaacttgctcagttcctctgttcctgagacactgctccggactgtccccccagcttgcagcctggtacctgcaggaggcagcccctccacagtggcttgcagcctccacaccccactgccccggttagggttcgtccttcaggtcacggggcctcagccctggactggctccgactcttggcaggaggaaacgtcctgtcacttccattagaaatcttggccaatctgctccaagctctccctccaggaggggaaggagagagccatgtggagacttgggaaaagagcagacaggtggaacagccagtgtggaggcttggaggcagcagtgggcctggtcagggtgagggcagcaaggtgtatggcctgagcagagtgggggcgagcatgagggcaggccaggggagcctcctagagcctctctgaggtcctggctcagcggtggttttactgtcctggcgaacccaaggcaactcgacaaatcatgagtggctccccttactatggtgaagggaagagagcagggccgagaacacaggctctggagctggtctgtctgggttcaaaccgcagttccactacttgcccgaacgacctgtgcctcagtttcccccaccccatataaaggaaagaacagctacggcatggggacgttgtgtcattcagtgggctgcagctcactatgagcatgccatgatgctatcatgttcattttaccatttcttccttaataacgtcccctgtacagggataaagggattggtcagcccaaggttccagccagtaaaggacagagccatcccggtcccgaggatgctgagtccccacctccacaccaccactcgctccctggggtgcagcaccaggtggcatgctccccccccactcatcccctcggcctctctttttctgactgcaccatggggcccctctgcccagattctctccttgtctctagagctttctccagacggggtggagaagccggcctgtctgcctgagagggctggtcggagcagttggtggttgccgcctgaccgctcctctgccccttccctttggtggaggcccaggaaataaaggatttgaaggccgcacacctgcctccacgaagggatttgtgtgtgtgtgtgtgtgtgtgtgtgtggctcaaagtcaatggtgtattaattaaggggaacagctgctactgcagttcttctgataagtcagtgacaaatggccgtgtttacctttctcctgagcagaggctccgggagatggcctggagctcctgggtggatgtccagggctgagatttgtggggtagagcctctccctcccttacccgcctccagcttctgtctctgtgccaccaagcccaagagggctgtttgtcactgaggaaagacaggcaggtggactggggagccgtggaggggactgggccgggcaacggaaacttctcaacgatggctcctactcgaaaagaggcccttggaccccctcctcagccgatcccaccatcctgcccttccccttgtgcacttagagctgcttgaaagagagacttggcccttcaaaggggaggaaggctgcagggccggatctgaggctctgcggcagaggatgcagatgcaccccggggctttgtgcgctgcaggaaggccggggctggctgcccaggttgggggggtggcgcggccttttgttatttcacttattttgatctcgctcctgctctccaaacagcctcacagaaatagagccctgcattagctcccttcccagcttaagacaaaacaaggcagagggaaagcctttccctgaaaaacagaaaagggcaagagaggtgggctcaagtttgtctgggtcgtgttttctgggggcttcaactccatttctccaccagatctcccacagtgcgaaggaagggctggatctccgagccaaccccagtgtctccgctggtccccaggcccactgtgccctcagggtagtggctaccctggtggagatcagtccacctggaggcccagaccctgcggagtcctggagtcctgcccatcctgcgcccccccagatggcacctgggcctctgcagccgtggcgagggcaggtgcagagactaggctgcaggggacacggatctccgcctcctcggaaggcaccaccagctgccaaggagcctcatccaacctttccctgctcttcgtccccctcccagggctgagcacgcccaccccgggagcctctggggcccccaggggaggcagaaatggggccagaaagaggttctactgaccctcaccctttgccaccactcactgggaccaggctggtgttctgagtccaccctgccgggtatgatagccacgctgtgttgtaatagggaaactgaggctgagaagttatgaggcttgcccaaaaacctgctcatggaaaggctggggccgcatgggcagccttgggcgaagacttgggagaagacacccagccaacccgccctggcctcctcttcccactgacctcttggcaagctgccgctcctcacaacgttgctctgtgggggaaagggaaagaatcgtggacgagaaacacatccatttttaatagtttatttatccaacagtttcaaccctgaagtgaagcctgttgccgcgtccgaattccggctggggcctgattagaccattgctttgccgtggggcgggcgctccgagccagccccgcgctcatccagacatcagaggaaatgagagtattgctcaaatgagggagatggagctttattaaggaaacaaaaaataccagtaagaccgacaaggggtggctgatgtcttctggaggcgctgttgtgggcgccctggctcgcccctctcccgcctgcctcggaggagagcacagggggacgaggctctgctcgaggggctcctcgcgttgagttaatagggcccccggcagggcgcttctggagccgggcccggtgggggtgggggtgggggtgcaggaggaaggtctgtggcggcgctggcacgctcccggcggccggcagccatgtgaccccgcaccccgcgccccccaggtcggcctcaagttctggccctacggccccgcagccctgcagggggccgcccgtggttgccctggagaggggtgatcgttgcacaacggagacgtggcactcccaagctcccggaatccgcatcctcctcgacgcagtgtcgcagtgtggcactgtgagaagcaccactgaagaggcccagctctgaccctgcgggtggcacggggcggccctgccctctggccgcccccgctccgggctcctctcaggaggccgcccccgcagctcacccctcctgactggagggtcccgtgtgccaggacctggcatttctagatcttctacagtacttgttctactttctagcaccttaccccttcaggataaaagaggcccaacccagctagaggacaggctttctcccctcacccttgagctcccggtaacaccctctgaaggcacatggaccaaaccgctcccaacccctgctgccccagcctgccagcccgacccacctcccacaggctccacgcccaccctgctgagtgctcccgcggtggaagagctccagcccacctgactgcatacttgctctgcagggtctcccagctgctgctctttcatcttctctaagcatcagaaacaaacccttctcccccttcctgccagccaccgggcagagaggactggaccaatgcagaggacgagctacccacctggcctctggctttgccacccacccccaccccgctgctgcccctcaaggaagcccaagctttcctacaagctaatctctcaagagtcttacagagagacctttggaaccagagtgggaaggagggtgaaagtcaaggcaagcgtgaattcagcactggcaggtctggtggccttctcacgcccctggaggggactggcctgggacaggctgactgggaaaaggtccccgcccaggatttatcgctctgagtcggagaaggaggagggcttagtccatctccacaccagcatatcttccccagccacgcggtgggactctgtctggatccgggattcattggatgctaggaattccacagcccggtcccagacacgcttcatgcgcctcctgcaatgagagggaccaggttcagcagcaaggcagcagccccctgccccccgcaagctctgtctggtactgcccagagaagcgagctggcctgtgcacgccctggggacaagaccccaggaacccacgcagaatttatctgtgggaggaaactgcgtcaagtactagcagaactcctgcagagacaaatttcttgagccacagaaaaaaattatccctcaaccttctctgctctaaaagcgctcaattaaagggagccgaaggggaccagaggtgccggaggaccccctggtgtgtctgagtgggactgggccgtgctgaccttggccagctcttgccaggacctgttactgcagcagccccagccaggcggccccatcaccagcactggctgcattttaatgccccatgtgggccaattaaagagtggccactgggctgtggaatccaaacttgacagtgctttggagcatgggaatgagctcagcatctgacgggggaggccaagaagccggagctgctcccctcttctgctctgctgggtccccggggcctggcatccccttggaccgcccctataacctcctccccctccagactagacaggaagattccagggcagtcaggttgctctgacatcttctctttgatgagttcctgtcttttggcagttccgcagcctgcctctccatgacgtggagagtgactgtggacatgggcatgtgtgagcaggaaaggctccaccagggctcaggacaacaaatgagggaagatcctgaggtggcctctgggtcgggagtaagaatgggggtgctggggctttcttcctcggagttcgggtcctgtcatgagcgacccctcagcctgtttggcagtccccacttgcctggtgtcacccagccctccctccctggctgcccattaataggtgaataagccagctgcttttagcccccctgctttcctcaccagccaggctcttcagccctccctcagtctcacaggcagaccctcatctgcagggcaaacctgagggggcccacggcagcggatgtgtcctcacaactggagggcttggctgcacagatgaggggtagcaatcaagaggctgagagccaacagtgtgagtctcccgggtttcactgctagggctcagtcccgagacaagccgagacggcacttttgcacttacttcagtacatgtgtgggttgcacataaccctagctggagcaataagggctgccctgggatgagctgtgaggccacctccgacacccccactccccttttcctgaggccttgtcaatacctaacagcacagtttccttatgcatttgttacctctcttcctcctgagaagcaacactccagcacggtggggatttgggcttcttccccacaccccaacacaccccacccccgtgactcaggagagtatggcccatagccaagtgctcactaaacatctactgaataaaggagggcttcaaagcaaccctctgcaaggtggtggtattgtctctgtgtcttggatgaggaaagggctcaaggaggctgttccccaaggccacatgagactcctggccgggccaggaatttggtggtagtctggatgcaccaagtagcctccccctgggagcaggacggccacacggctgcctcatgctggacaacaacagcaagcacaagccaaggccatgatcccagctctccctaagcttcctgcctgcaccttcccaaggagtagggaaagttcttgagcatcttcacatttaaaaatggccttaaattcacatttaaaagcagttttactcttccacttcctcttgggttgcacagaaatgccaccagcggtgggctttgagcaaattccttagcctccacgtgcctcagttccctcatctgtaagatgggatactcactgttctcacctcccagggccacagtgagggtcaaccaagtgggactgtgctggggaaggcccagagcaggatggctcacagcgagcactcggcaaatgtgagtgcttgtcactctccgaggggatggcatccagccggagaccgtaccaaactgctgacaagggcccccagtctgagcccacgccatgccagggccctgctggttgggccctgggccctcctcctacaaagcttccccacgtttggttttgtcaggggccacctagcatctgcagcccatgtggaaggccccctggaaccatgcgtgacaatggcctgctacccctgcccatgcagccgtgcacctgaccacatccattgccatgaaaccccgcgttcaactacatgcatgcatgtgtaggtgtgcctgcgactgtgggaagcaaaccatgatgttttaggggacgtgtcatgggtcatggttaaaaatgtctgaaaggcaatctcatccttgctagtgactgattcaagaacacaagtaaccagttctggccagcgaggcctcaaggagtgtgtcaccggcagcttctgggcatgttttctcctgcccatgagagtgactggaggcccatctctccccagttggcagtgacaaggcagacgacgatccagctgccgctggctaccacttgtgtctgggaggaactccaaccagcccacaacatccggaggccagggccacaagcatcacagagaaatggcactagagtctcgactattctgtgcccggagcccaagggactctggacttccactaatagaaacccactaggtccctcccaacttgagccactggggggaaggcacgagcacctgccacccacagctctccagttggtatcgacgctgacagagtggggtcatgcttccgtacttcggctgtgcattctgccaaagatccgagcactggggcagcggcgggaggtgtgcctggccccctcatctgtgatcctcagggccgactcgcagccccttaactgatgctctaggccctctcctatggcaccaggctgggtcagcccaggactcaccggctctgtggagggatcagggtgtctcgcacatgcaggatgcccacgtatgggtagcgctccatgtcctgctcccagtccacgtagtggtcctggaccacatctgcaaggtaggacagaggacaccatataggggaaggacgttctggcaggtgccagtggtcctttccccaggggccacgcacctataatcttcttcaccatctcatacatagcttgttcctcttcttccagcttccgccaccgatatttcaggaggatcaggagcccccacaaaaaggccaaacctatgaaggaacaaaggccccgttaatccatctcatcacttgtggccattcagctgcatgctgggtctcagtgcaggccagtcgctgtgctggaggctgtcagtgagctgcgttaggtgtcctgagaacctgctatgtgtcaggccggggctggcatgcagcttacgcaggatggggagatggcggaggggagacaggctacaaagtgatcatcttcctctgccggttgtcaccacggaggcatccccagctgtccagattgaggctcctcccaaccccattccgggctttcatctcctcccttgtgaaccagaccacggggtttcatacatatacacacgcagggccctttgtattccaagatgctgctgccgataatgacgactctgcctgatggcgtgggtgagggagctgtgtgcacgcccaaatggctggtgatttgtctctctgccacgtctgcagagctggcagtttctgtgactcggcctttcaccttccaaaacaccctgaggtctctgttcaaaggcagcccctgatgccaggccacaagatgctaagctctgctttgcagctcagccccctgggtccttcctgctttccttgggtacccagagctccaaggaggtgtttacatcgttcagggagtaaaattaagccaagctcctgctgcacctcctcctcctccgagaggcatgtgccctggagctctgggggtgacgatgctgggctccagccaaggcccagctcccccctcggggacaatgatagtctctgaccccgatcaaggatattttccagttcccctcatgctcctgccaccaatctctaaaggtaagatgacccagggcagaggctgacttgttcatctcctctgttttattagacctcaggttcacgagacagaaatgaactctctgggcctgggtttctatagctcatcactcatgcctaggagtgtcactgagctgggctcccgggaggtgctgtgtgagcagtccctatgccaagggcgggggaggggcttctcactattgtgaagggggtgggggtgtgtgaggggagaagggcagccaaggacttacaccagaagaagatgagcaggttggtgatcgcggtgaacagggcacggctcaggcggcagcccacacccatgcgggggcgggcggattccaagcagaccactttgtccacagttgtcaccaattccgatgggtcttcccctttcaacctgaaacaggacacagcgctgcaaatgcattcaggagctcccaggaaccataggatcagccccaatttgaagcaaggggagatgaaaggaggggctttgaggcctctacttgcttataaaatagacttggtatcctggtcgcatactttccagaaatttcccacattggctacttagaaagaataaagctttaaagatggcagcaggctcgaacccctactgctaaagtgacgtctccctctgtcgagtcttctgacaactcctctcagcgtgtggaagattaaactgtaaattggattcccacctcccagcatatagaaatggaaatgtttactgaatcacattgtttgcactgcatagcaagaactgaaagagtctggggtgtgcttttcctcgttgatggtgacaaggaggcacataagctgtttaagtataaagattggggtgtcgtgaggctcggggaaggataaccactgggctctctgaggctaggctcccagccacagcgcctccactctggcctctgagaggtgtcaggacacatggggatgcccacgcctgcaccttcttctggctaggtgacagtctcatgtatgggaatgcccagtgtctgaagtgttccgatttctcgtgacccgctttgaacactggtcgtctgagctgggctgggccaccctccgactgtcttcccacagtgtgaaaaggcgagtgccatcattcttctgtgctagcagctttggtgagcactgctgaggataaaatccatattctcttccgcctatcctaacacacaacaggaaaatcgctcagccactcagggaagctttatttattttttttaagccaacgcattttaatcgcattttaatcgtgtcctgcatccagttatcaagctttaggctgaacagcctgaggggcttctggtggaggcactgctgatggaattagtagtctgagtggattagagacggagggaacaaaaccctagagtgtacttgagtatcaggagctgtggcctgaacagagaccctaacaaaccctgggaaatgggagggagtcccagcatgaagaaccttggtggtggcaaggggtgggggtgtgggtgggggggcatactggtgtatgcagccagatggggcttttcagaaggctgagagggctcaccatcctggctaacagtgctccccgggggtagaaatgaggtcaaatgcccagtcagaataaaatccagtatgtcctttttcaatttccgtcctgagcgaaaccgacagaaacatttcagctaggaatgaagaccagcaccagacaaaaggaaatacagaatgacttctctatgtgggaccagcgagttcaaagggcacagagtgagttacttgaaactcaaaggtgtaggtagaaaactaggctaacctggattttgtgtcttatcgtgaagtggctccttccgctgcaccctgaccaccttttccttctgttgcctggctgtaggcttagcccacaaggactcggcagggagacctggctctaccttcagacacctctgtgagctgaccgtggccgcaggtgcccgtggtagtgcccccaccctgtgatgcctcgcccacactcaccagatgcccacatccttgttactgctcagtatccaggtcagcgcagcttcaaacttggcaggggagttgccggtcacattctgtgggagggggcgggagattagtgctgtggctgggcggaccagctagaacattgttctcctgctggattagggaagacctatcccgtgtcctccagcgggccccagagccccattccgctaaatgcacgacaaagtggaaggtggaaatgtgggttgatgagagccaagaaggggctctaccaggaggagtcgaggtgggagcacacaagaaagtgatgcaggtctgaggtagccaaaaacaattttctcaagtaccaaagcgtcaaggggtagcagctcatcttggggaaaataaaaacacgtgtggggctgggggccccaggggccagtccctgcccctctctgggccccagtctcctcatctgggaaatgaaaataggctaggggacccctaggtttctgctggctctaaggttccagaattctgtcaaactggggccaggccaacggccacacagacccggagcaatctacacagtgaacataaaggagagaatggacaggtgaaatgtaggtctgtaaagctgctgggaaggggagaaaagcggggggtaagtaatggggctgcttcaagaagaggcggcctgcagtggccataccagctgctcaggagacccccacctacctgtggcaggcagggctccggctcacagctcagctgggaccaggcacctctcctgctgcctaaactgaaagtagcctaacactcaactaagttagaaagaaagaaaagaaagaaaagaaagaaaagaaagaaagaaagaaaaaagaaaagaaaaggaaaaaaagaaagaaaagaaaagaaaagaaaagaaaagaaaagaaaagaaaagaaaagaaaagaaagaaacaacaaaaaagggaaaacaaaaatagccaaaaagcaaacacaaaatggaaacagaaaaaaaaggcagggtctgaaagatcagaacaaaagcaccaggacctcctgggagtgggtgagcgctgcagcctacttactgctaggtattcctgggcttccactacagggatgcatttgctttttagcttctctggatttccacattcaaaattacctaggaggaaaaaacacattcaaacaaaaggaagaggtggggaaaaaaatactctgaaatggactaaaaaaaaaaaaaaaatgcagcaagaatcaagccatcagctttaatggggagcatgtggccccatgactctggtgaggcatcctcagtctgcaccaagatcaaaacccacttggcttggatcgattccagatcattaaaacctgacctgcaaaggagtgcagtgatttgcattaaatgactaaaaagctacccaatcctaaggtctgttctcaattgatccctaagaggatcagacaggtagctttggaaggtaccagaatggcactataaataaacgcgacccgggaaaaaaaaagaaaggcagggcggctgcaggcactgcagggattctggccatggcacaggcagggggctaggaactccaggcccactgttttgaggggttctggggagggaaggccaaaatgccccacagagaaagagggcatccctgtgctgggcagtggggcctcagtgtggtgccccaaggggccacccccttctgattaggtcccacctaggatgaagctgggagcctccccttaggcccacccagggccacctcctctgaaaactcccgagcccatggggaaatcttgtcggaccaaatcactctggacttgggggcctgccacagccagtggctctcaacagcccactatggtccacccaccattgttctgcttcctgtgggtcactagatgccttgagagcaggcacagcacaggctgggggcatgtacaagatccttaacccacacagagcctcactgctcttaacctggcgcagcctggggtctggggagggagtggctgagaatgaactttaaaaatcttgagaccaaactaaaggttatccctcctgtgccaagttgagcttgcccttatgggacccctgagatcaagctggcttttcccgacaggccccagaatgccctgccccgcttaagctggcctggaccacagccatggtctcctgattagtttcgtcctctctcctttctcatccacgtttgatcaacaaaagtttaaaatgattctgcttaaatcgcactactacactcaagctgccgtcacccttgccttcctagctcctggctctcaacatatcactctgctgctcaaaagcctccttggcattcaccgcctgcagtgatcaaagccctggtggcctgacatctatggccatccatggtggggcccaaccaacctttccaaactccattccttcccctatgaagccaagagcttccatccctgactctgtcatttcccgcctcttggctctgccctgccccccacatatacagaatcaatcctccttgggcttcagggtctggcacagacaccacctcccctgtgatgctttcctgactgctccagctgaaaggtaacatgcctactggaacttctggcctctcggttctcatctaatcacaccttttaacagccattggtcagggaggtaggtggcctgtcccttctactagatcataagcaccctgtggactgcaagggaagcacaatgccctgcccataggtgacctcccaggtggggttggggttgggcagagtatggcctagcagagccctcattcccctgcagtgagaccctcaggctcgccgttggccaggcttgtcagaggacaggaggcactaggccccctgatggcataagccaggaccacaaatggagggcaggatggaggagaaatgtctaccagcatctctggtttaagacagagcttccctactttataccctagggcttttcaaaaatgcagactttgattcataggtttggaatgggtcctcagattctggatttccaataggttctggggtgatcctaatgctgcttgtccctggaccacaactgagttactaaggtctggaacactctcttaaagggccagaatttgggcagcctgggtggctcggcggtttagtgcctgccttcagcccagggggtgatcctggagacctgggatcgaggcccacatcgggctccctgcacggagcctgcttctcactctgccttgtgtctctgcctctctctctctctctctctctctgtgtgtgtctctcatgaataaataaataatatcttgaaaaaaataaagggccagaatttatagtccaaggacccaggccatgcagaaaggcccctggggcctgtgatgctgtgagctcccatgcctactgctcctcctccgagctcacagatgccttcctgaccgccactagtctcctgccagtcaggggaaggtggtggcagagctatggcccataagacctgccccaagggctgagggcccagtacaagcccatccagcctggattccctagcaatgactttagacaagggttggccccacaggtaagaggcgcctcttgaacattccataagactgaatagttctgtctggttctggtgcaccaagcttggggcacaagctcaggtcacactatgccctaagcaagtgattctgagaggtgtggggaggtgatatatctggcctcaaagaataattttctaaataaaatagtagggaagccttctggatggattactttttagaggtacttcatgggggtactgaaaatgtcctcctctagagtaaaacaattttcatttgttaaaaaaaaaaaaaaaaaaaaaaaagaccaaggaccacttggctagagagggagacagtttctgagaggttaagggacttatccgaggtcctgcagctagatggggagatcaggaccagatgtgacacgggggccctggcaagctgggtggacctgagtgtgaccagcccaccgggcaggcccctgccacttgcataggcctctcctcctggcctgaccgaccatctggtacaggaggctctccaggtcagaagatccagactctgaggagacctggggcctggctcctgcgagtgcaacatgaaagcatcgagtggtgggcatccagagaaaacaggcttgtgcaggggccaggacccctgagacccttaaaggggatatgaaaaccaactataggcttaagaaagctgtgtctaagtggagaattggggcaagacttggtttctgagtgtgtcttctgggagatcaccagcaagcatctcggcctcctgccagccagccccagccaggctgatgaggggaagagcccacagcccccacgaggaatctcaggcccagagatatccactcaccggcttggacggccaggaagttgtagagttcatgcagcagctccagcaaggccgccttctgcttggcctgacagaactggaagggcacaggacaagcagtcagcaagcagtggtgggggcagggggctccgtccagctggttttacctccttggctgcactgccaagtgctaggcagcaaggcacaactcctaacccaaattctgtaaagtggtgggcccagggacggggtcgataaataccgggttaactgagcaccatgaaaacagaggcagaactaaaagcagacatagtaactaaggaattgccatcctgaaggctcccagcctctgtcctgcagttcccacgggaataaaggctattaagtagggcggtggagcagaggtgactaggctgtggggagatgcagcagcccagcttccctggtgggccaggcaaatgctactactgcagccttgtcttcccttgggccgctcctgtctgtttttggagagtcaggtgcctacattctgcctataaattgtctgcccggtggattagctgcagcaactgcttcatcttagactggattcctgactagaagtgggaaatttctagaaatcttaaaactatagaggacaaaagtcatctgtatgagaaaacaggaacacgaatacacctagatctcctccacttataacagaattgaaaccattttgctagacttgctagatttagaatatttaaaagaaaaactgctcttccttgagagtgaatgacgggctgtcatgagtctgcactgaatcctcaccacaatccttaccacaccccaatttctcagatgaggagtccgaggtttagagtccatagctaggccaccaagatcccacagctaacaagtgctgaagatggtcaactccaagcctaccgcccccttcagacctcctctggggtgtcactggggtgtcctgggctccgggcctggcttgacaactgtggaaagaaccacagtcactttccttcttgggcttgcttgatgccctcatctgcaacgttgagggacttggtttctgaaagtctcagaggccaagatatgttcccttgtgttgcctaaagacccaaaagcctttccaagtacaaaatggggttaccaagatttacacacatgactgttaacgttcagaaacaacgcacaaatctgtaagtagaatcagatacccaaactaccttttaaagatgaatgtgatggaaaatgttgataataagaaatatagctgaatatacatggagatcccaattctataaacatacatacacaaacaaatgagaagggaaggaaatacccccaaatgtcaccaaaattatttcttggtggcagaatcatggctgattttggcacatttttttttacactaaacatctattactgtcacaaccaggaaaaaaagagaggtggtcacaattaactccatttcaaactcaccgacgtttaggcaaagcggggctgatcccacctaaagggaacagaaggacggaaggcactagaccacgagatggcctgagacagcacacccactcccagcctatccacgcgttttcagcagcacaaaggcagagagaaaaatgctaagtgtcatagttggctgagaagggaaagaacacatatctctcaaactccaatgcccatctggattctgggggagcctgagccacacaaagaataagacttttcagcaagagcctcaccaaagccaagagcatctcccaaactgcctattcctgtgtccacccttcatgacggccaagaacaccccatgagatctcagctcattggggcctgtgatgaggcccagactctgccttttgatgccctgatgttacgagtacccacgctgctcaccgagcacatctttagcaagatcccgggatgggcccgttggggctcactcagctggggagatgaaccaagagatagaaaccagagaaacaaacaaacaaaaaaaagataccagagaaatcttacagaaaagttccttgctttcgggttcaaaattctagttttccctctggccactacctatttttctgggccacttcctgtaatcatcaactgtggtttccatgacagaaggcactttcaacttaatatgaatctgttttcacaaaacaactgagaggcaaagatacttggtggatgaatgcaacaagtgaatgtaataaaacatccccaaagatgacatagcggaagccagagaagaaataaaggctattatttacaccaggccaccccttctgttaacatggataagagagtgaactcttgactgtgtgcactttcctaggccccggggctgccagacgtggagactgaggccttgggagaggcctggcattgcacacttaataattagactactaagtcatgccctctagcaggaaaaggctcctgacctggtaggatttatgacctgaaaatttactgcctcctatcttccccagactatcacctgtgccagcatcccagctcctagttaatgccgcgtgcatgactcataaatggatggggctgctcgccttccccaaatattatttgtagggaacattaaagcctcataaaacaaatctataggcaagaggcctaattccacttcagatatatttaaaacaaccccacccgctccctgatgtttcaaatccgaacagcactgtcagccacagacaccggagcagagggaacgtggacctgagaactcggcctccagaagcttaaaaactgccagcccttcctctggaagccagggagcttgagaggtcctttagcccaacctactgcatccgcctagattgacttaggcagatcaaagtccccggcgctgtgagtgatgggagaggtaccataacaagccagggttggatcttgggagttctattctttctatttcaagtactctgtcgcctgccacaattgagtctgacacaaacatcacagaacacgatgtgattctggtacattacaggaagcactcctgaaaatgatcctattatgatccttttctggggaagtttacctcctgatggaggctaacatccttggggggaataacaaaagctagagaaactcagactcaccttatctgttttgctgtcacagtccactggcaataatttcactgagaccaagaaaagaaacacagaggaaattaaaagtgtgggttcaggaaaagattacaaaagagaaccattcccaaaattcagggtaagtaaaacattcccattaagggtggggaccagaaagatgtcctctaagtatggcacttgtaaaatgtcgatagtaacatgtaagggtttcccaagcccggatgaggaatcaggactaggaccactggtccaaatggtagctggaaatgattagccatgggctcttgggcaactcaaccactctgaacctccacctcctcatttgtagaatgggatcaataaagcttccgctgcttaactcaaggagtaaacctcaaacaagtcaatatacatgattgttttgtaaactgccaagtgatatgttgaatagggatttgtaccaccacgggaggggagctccagctaaatcccaagatatacccaagagctgttgtcttaaagtatctcagcagggactatgaaaattgtactgtttgactgctgtggtatcatatagtcccacgaccctcccaggtctgcttaatttctttagcaagtggatagactgctctcatagccaagaagttatttgggtgtgtgagtctgggatccccatgcccacagacttgttcatatacccaaacacccatctgctgcaacagctaaggtacaatttggcctctccctgcattttggctgttcctgctaggcatggaaagaaagatgtggcagccttggcttgaggctgggaacagtattcatcacaatgctttgcaaagaatatcaaaggctagtgaactcactttatactttagatttatacactttaccctttacattttcatgttgagactaaagcccagttacccaagaagcagattccccttttaagaaacataccaatcctcaactagtcaggatacccactgtatcctgcagacctcttattggcatgtccaatcactaactaaaatgtggacagaagcatggccgggaatgtccttgactcacagaactctctcttaacacactccaggaggataatgctagcaaggataaacacctccatgtatatcagtttaaacgcttttggtgatgcaaagctgggaacccaaccagatccgatctgtgggcagtcaaacctggggtgtcttcaaatgggcactaatgtgtgaatgagccagagatccaagttaagaaagaactaaaaaggaatgggggtggacctgcctgttggagaggggtgtggttttctctggagagggaaaaccagaggttggggtggaaatgactaggaatgaagactgcttccagcacgtggttgaaagggagactggtagggagggcgagggcagaaatggagaacagaacaggagagtgaggacagagatggctgcaggaactccaggcctcttctcccgcggcggcggggagcagaggcaaggtctggaggggagaagacggccagaagcagctggcaaggcccgggcggggcagcctggcgtcgagaggaaccggtggcctcaggtgggcgctcactcgcgcgcccggggccctcccctgcgccggcccggcccgggacgtactgttgtcctccgcctcctgcggcgccgagggcttgcccatcttcacccagaggatgcccaggaagacgagcagcagccccaggctggcccagaacaggagccgggacaggcagcgctccagccgccgccccgcctcgggccgggcccgcgccgcacccgcagggccagtgcgcgtggcccgcaggcccgggcgcggggcggcgccgaggagggcggagggcggccgggccggggccggggccggggccggggccggggtcgcggcccaccagcgacggacaccgtggcccggcgcggccctgtcgagcggccgggcgtcctcgtcctcctcggagctgccccgggccgaggcgcggcgccggggcggcgcggggcgggcggggtaggcgaggccgcggctcccggcccaggacgccgcggaggccccgccgtcgccgtaggccccggaggtcgcgtaggccaagcccgaggccggcggggagagccagggctccgctcgcaggggggccgcggcgggccgggctcgcagcggcgcctcctcgcgcagccgggcctccccgcgcagccgctcctcgccccgcagcccggcctcctcccgcagccgctcctcgccgcgcagccgggcctcgccccgcaggcggcgcagcttgttgcggtacacgtcccgggtggtgtcggtgatgggtcctggctggaagcccagggcctgtagctcccgccgcagctccaggtccgacaggccggccatggccaggacgccgccccccgcccgcccccggcgcgcaccgcacccggaactgctcccgccggcggccgcggcggagcgggcggggccccgcgccatgatgggaaggtctgtccgcgccctcccgggtggcggccatgttggggaggtcagactcggcccaaatgccgccatgttggggaggtccgagaattttaaaaatgtttttcttcttcctttttctctccttcccctcccctccttgcccagtccttgtctgtaagaccgatcggtgtttctttacgaatactcctccccatgcgcggtcccgggcacgcggtagacacctagcaaagtgtggatttagtggtgaaggacgagcccctgcggaccctttgcatctttcttttttttttttttttttaattttttaaaaatttatttatgatagtcacagagagagagagagaggcagagacacaggcagagggagaagcaggctccatgcaccgggagcccgacgtgggattcgatcccgggtccccaggatcgcgccctgggccaaaggcaggcgccaagccgctgcgccacccagggatccccctttgcatctttctgtgcttggggagggctgtgggtcatggactaggcccggcctggaccccaggtggagggcggcgggcctgtgtccaggcgctcagcgcagctccggaccgtgggccccgccccaggcacctgccccagagccaatgccccgggcgcgagtgggcgagtgggcggcacccgccttgggaggaggccctgtggtggggtcttcctggaggtgggtggccgagctccgagaccgtccgctgtcacttgcggatttaggtggggcctctcaaacgccaggggcgccgctgttagatgtgtgatcacatccagtgaacatttctggcctcccggccagtaaagtccgaaacgagaattagaacagggcttgggcacagggcccggtacgtgctcccacgtgtttatacttatcccctcccggcgggcatcggcagtgcagggacacctgactacaggacctacaggatggctcttagctgagaggcccctgagggaagcctgggggccgaggcaagtgcgagcagagctgtggctcagggtccttccacctccctcccctgtttgtaagccttccacggccttcttcatccccacccccatcccaaacgtttatggccacccttggcgtcttgggttccggtccactgcgactcctctaattcggttctccccttgcctgcccatcgcccaccccccaccctgctttcccctctcccttccctgggtcatgggcaaggcccctctgcgggtggtttgcatccctgccacttgccgtaccaccacgggggtattcctacactggccacggttgctggaaaaattatagcctctgctcggtcaggcttccattgttagcctccccgtatcccccaacttagctgttcccatgtggtgcaatttttctcaccaagtgttttcctcttctctgcctgtgtttgcacggaatgccatgaatttgatatagtgattgcctaacacatataccacataatagtattttatttctttctgaagcgctgtttgcatgacaaatgagttggtaacatttgtgcaactccttgcagctgtgcagttcaatatataaggaatgagcctttcagcatcaataccggccctgtgtattctaagagggtttgaatctgacgcttcaacaaagtgaacgttctgacatttcgcagagttacggtctgtttcatcacaatggatcccaggatgatttaaaaatatgtactgaactggagccgccccctgcagtggtccccagtgtgggctttgtcagcctgccttgtgtttggggacgctgctgctgctacacatacctagggccaaatgacccccacccgtccagcctgctgtcttccctccagcctggaacccatcatgttggcagccctggctttctgcccccaggtggtctaccctctgcctccatgggactcctaacagatgctcaatttgtctctctgggtccaaggagcctttggggtagtgccgccaccaggcacagcacgtttgccgatcaggactcccagcccgcgtccctgccacgcccgcccccaggcagaagcctcaccatctgattgagaaaagtcaaccagaaaacccctcacaagtcagtcgtccttctcaagtctgcggcatctctgttttcctcctgagcatcctgtcccagtcctgttcctccgtggattgacagtccctctgaggcctgccatcaacattctgtgccaagactactttacctgcttgttgctgctcatgttccccctgcatgaccaccacatgctttcttcactgaccctcatgttttccaggccccggctgagccgtgctgcttctttggtacccctgcgtcgttttgggagctgcccaggaggctcttcctggcacgtgcctttgccttctgtgttgagtatgggaacgcatattttaaagaaaaaggcaccattgcaaagtcagtggctgccctgcaggcccccctctctcctcactttcttgtgggttttttttaaaggtgagcagccgggctgtgggcagtcttcctgatttattaaaggcagaagtggaaaaacaagctgcaatgtccaaatatacttagtaaccacatccacgcatttagcagaagcgaggggcctccaggaggaggaggctctggattcccagagggctgccacgctgcctgccgtcctgctgacctccctctgtctcagcagagccttataataacaacagccataaatcttttagtgggttccattctccttcttctcctgcaaaaagccctgcacacatttatcaggtccttaaatatgcagggggaccatggactcatcctcgatctaccctctcaccagcctcaagcgtccctctgggcttccttggaaccatattgtgagtggtgtcatgctgtgcggtggtgggggcactgggagagtgtggttgaaaagtaggggacaaagcaggtgccatctaggctcaggttttgactgggaatgttcccagcactgcccaacttctggctgccccatctcagggctctggtgaagaggagagccacctttcatctctccaggtagacgaaggggcaaatagagtcacagggaaatgccagaacaggtataatgggcagttatgttggctgcttttcataatcggctgaaaatataacaaaactctcattcttttggccacactttgatatctgtgggtaagagttctttcagaagcctagaatacattccctgatgtcaataacgaattgtgtatgaagaaaaatgtaacgctttcagaacattttcttttgggctttgtccatgattagattatactaaattacagagtacagatatcaggcaattactctttgcttttaactattcaatttcatggcaaatcctcatagcttggtaattataaaatcataccgatgcagttactgagaaaatacctcatcatctccatcttgtgaagctgggttcaggttgccctctaattacccatagtcctgttaagtgtaaagtacatcccagatgaagagggggtaatctgtaactcgctgtaacggcccagttttctggagagattcttgcagattttgctggatagacctcagtaagatgtgaggaaggtgggtgtcttcacctgactggttcctctgggcacttgccccctctcccctcctggctgggtcctggtcctggccttggatagctttagccaagagtggatctctctttacttctgtttttttgaaaacatggtcattttggtcttggctcagctcacagtatcctcccagcctcccccagttttaatttcttccagggctgtgcccgtcctgtaagcaatcgagtctgctgtcctggaaactggaggaactcgtcagagaaaaagaattatttgagccgattgtgagaaattgaacaacggcaggaggaggaaaaggagagaagaaaggagccgacacatctaaccgggcagctggggcactgtgcatacagatgcaggtggcagctgggtccctgttgcagctcattactgagcagcacatcagaggccactgggtgagggtcacggacaacctggctgcaagcactgagctttgaacagggctgttctgcaggacgaacagcaccctcctgccacctgggtactgtggctgcggaaccaattcccattttcagaaatgcagactgcctggggtacaaccacctaggggcctcatttcctccttggcacctatttcaatgctgctatccaaccccaggatcttaaggaaaacctcccagcggggtgaggggtatggggggtggggaatccgagcaagcttgcaagcagagaggcaggggtggagggagagaggagcacccctcctctggtggtgggggaaggtagtctcagtgtagggacagaccccagcagagtgaggtaaagacacaaaagctgtgttttccacctagacagagaccgggagcattttgttggcctgcgttttggagtgggttccagataatggtgtgaatagcatgcatggtggaactctgaagggcaaggagtcctggatcagttcttcccaaccatgtactttgtagattctcctgcatttcttcctccttgctcctcccctgccctgtgcagccctctctccgtttattacagggtgccttggcagcatttcccaggaacctgcccctgcccttgagctgatcagtacgtacacaggaaatcgtgtgactgtgcagcacgaagggtctgggtcccatgtaaggtttgggtgtccctcaggagcattcagagcccccaaaggagcatcctttctaagggtcagagttatcttgtcctgataactatgatctgtggctaagctctcaaaatggctggggtgggtggaaatgtgaaaggggcagcatgtctagttgctggtaacctatggatagagggagctgtggttcctctaaggccccagtttataaataaatgaacattcattaatgtaaaattaaattagaatgaaatttctcatccagttttgtttagaaggcagaaataagtgggttggctgtggaattttgctgtgggtgctggagcgtctagtcacaagatgatgataataatgatagtgatgtgctggtgcctgtcccccccccccccccaatctcagggcacgcattaccaccttgcttttacaaaggctcattgaggttaaagggctagctggaagttacttggcaaggggttgagtgcagaagactgacaaggtctagcccattagacctcgagcttgccaataaacagaaagtagaccaggattcaggagacctggattccagtccttgctctgccactgactggtgtgtgggcagaaactgctctttcctcattggcacgaatcttccagttctgtgggtctgacttaatatttgaacatagaattgatcgaaggcagatgttttgctactgtatgtaccgccatttatggccaactccctctgagctttatttccgcccccctttatggagtgacttaaagctgacctttaaaaattaaaatattaaataaaaagagtcatttctgtatatttcctgctttatttgctggaggggggcttgcttgggagagaatattttccttcggagcctggctgtcgggcatgcagattttggggcctgcctcgggtgggaagcaggctcctggtgtcatccaccttttctgccgctggaggagcaggttgtcacttgtctgctggggaaaagaagaggaggtttgcagctcagtgacagcagttccacttatgaaactgacttctaaacctgcctgctgaccaaagggagaaggggcccgaggtgggaggggtggggggagtggggggattggtcaggcatctggaagctctgcaactaggtttctctgtagcctggggcaagtcatttaacctcgttcttccaccttgaacactttctccccacctctctcctcccctcctggagactaggagaagtaatcagtggctgtttgtgagacaagtcctagcttgacccaagttacttgggcagaccttgacctgggcgagggccaagtggagctcaggacttgcatctgtaaaacagatcaagaaaatgcagacctttgtggttggccagttccagagtttcttttagaaaatgcagacctttgtggttggccagttccagagtttcttttagaaaatgcagacctttgtggttggccagttccagagtttcttttagaggaacggcccagccttggtagtgttttgggaaggagcgaacatttctggagcagagggagggttgggtgtgttgtggtctgctccgccagagggcatttgggaaagggggctgagccttcagggcaggaccttgaaatgcccctggctggggaattgctcaatgattaggctctcctcagagacgggtgccctttccccagaagacagcttcatattctcaagtgcaaggcacaaaaacaaatcgtcatccgcacaccgtgctcaggtgcactcccagaatattgacacaggatggctgaggccaggtcccaggtgcagggccctgccttcccgtaccgttctggggggtcagcagcacctcactcagcagctcttccagggcggcccagtacttttccagctgcctggagttcatcttcattccaatttccacaggagcagtcaactgtgaaataaggtagagttaacaaggaggaagagacgcggagagcgccattaacccctgggtgccttacaggtggcgggagggactgctcagctgtggccccgctgttcctgatcctccttggacttccaggccggccagggaattgtggcacctcctcccctgcactcgaggtcgggggctggatctggaagtcgcacaagacttggctgggaggaggatccacaaagttccctactggggaagctgggatggaggggagcagtgggcaggaaatgccttggcttttcaggtgggaggaaactctccctccccctccgcctgaataatgacagccaacgcctggagccttagagctgggagtccttccggaagctttatgtataagaagcctcttagtaaccctatgaggtagggacgattagggtctccgtttcgcagatgaggaagctgaggaaaaagacgtagagtaacttgctcaaagccacacaggtgctaagtggcagagggaaaaggtgtcaatcccagggggcctgattctagccagcaggcgagactttctctagccctatggggacacaatagagaccccagaggagccgtcaggagaggctccccaccaagagaggtgggtgtggcccagctgggggggggggtgtgtgtgctgaccaatcttgccgtcaccccagagcttcctggctcagtgatcttggttcccacgccagccggcagacgggcagaagaccggggactccctgcctgtctggagagctgtacgcaggatttcccaggggctccctggcggtggaaaacaggctggggcctcccgaagggccacacggagggaaggtcactgtgggtccggctccagcccgacccacgccatccccttgccgcgtgctacgcctttctctccgacatcagtgtccttaaagtcaggaggctggacagaatgatccagaaaggacctcctgacccatgtgtcctggtctaggcagctgggaacagcctccccaagatgtcccacaggatgtaactcgtgccttacactgccaggggtgctggcattgggcagctccgactgagctcccctttgccacctgaaccagtcactcccagttcctcctgagagcccaaggagcatgtgggagaggaaggcacactgccctaaccccgtcgcccggtgtggtgacagccccgaggtccctctctgggccgtgattggcctccctgtttgtggtcacaggctgtgacaaccggccagggtggaaggatccgtggccggtggctggcgggaggcggaagacctggagtgcagcagctcagtttcaccctgactactgtgtgaccttggcgaggccctcactcactctacttatcagtctccccacctcccaggcccctgggagtgtcccccgctcaggtccagcagcgccttccttctccatccacactcacctcttctaggatctcacccagtcctggcttgaaattctagcaaattgctgatgcctcccacgtggatgtgtccagccctgagctctcctatatccacctgcccgtcccatgcctccacctggaggcatcttacagttcacagatcctgttccactcgaccttcctcccggcctcctgtggccaatcgtagggttaaccgtctccatgagtggcaaatccatccttctaggtcttctggcccatgaagtccatgtttcttttctttttctctatagcctaaattcatagcaaaccctgagggcctctaactctaaaatatttccggaacctgaccactctgctctgcctccaccatgaccaccctgggctgttggatgctgcagcagctccttaggggtccccctaatcctgcctttgccccttcaggctgttctcaacacagaagctagcgagacctttttttttctccgtaaagtaggctccatgaccagcatggagcccaatgtggggcttgaactcaccaccctgagatcaagacctgagctgagatcaagagtcagatgcttaaccgactgagccacccagatcagatgcccctggggaaactcttttaaaatataaatctgatcatgtcccttctctgctccaaagccctcaatggctcccacgtcagcagaatgaacgcaaagtccaaacaatagcctacagagtccactgtctggtctcacctcccactttttctgactccctctgctccagccactccaacctcctcactgttccttcctcactgttcctgggatgcaccaggtctacccctgcctcagggcctttgccctggctgttcctgctgcctggaatgctcttcccccagacatttttatggttcagtgcctcactgtctccaggcctctgtgctaatgccatgcactcatgaagcctgctctgaccaccctatttaaatcacaactcatccatctccattctctgctttacgttcttccatggcactactggccacaccgtgaaggttgcttatttatcctgtgtgtagtctgttgccggtccttctggtatctcgtttccggtcccccactcgagtgtgagctccacgagcttggaggatttacctgttttgttcaccactttattcccagggcccagaaccatgctttgcacttagagcttgggaactatttgtcgcctgaataagtgagtttgtgaaattaaagaggtgccctggacaaactcaaggctcactctgaccgctgcaatctgtgctatcagcactcagcactgacccgggggctgggggctgaccctgtagttgtctcctaggttccttgctagggggaggaactggcaccctcgtcatctgtcccctgaggacgacagctgcatcctgactgatctcctgcctccacttgtgctgtccaggatctttcaaagtcagatcaggtgacttccctgctttgaaccccaggtgaccttccagacatctagcctggacaccaggccctgccaacctcttgttctctcctggtgcaccctcgcctcgaggaccttgcaccttcagtgtgcttcctgagcagggcctttgcactcacctttccttccttctggaatgttcttgctctagctctttagctctttgtatgagaggctccttctcatcattttggtttcaaatcaaataagtgtcacctcttctgaaaggccttccccgacccctcccccagccaaaggaatggccctgaggcccatcccatcatgctctatcctacctcctatgtggtgcctgaaatggttccttgtctcattgttggtgtctgtctccctttcttctaggatggagcttgttgccagaatgtctagttcgctgccgtatcctagcataatctgtggctggccgggggagccattccccagcgaggtttctctgcatcgcccccctgcctgctcaccttgataacttggttttcttcttcctctgtgggctccacagagtccagaggccccacttcctcagacttcttctgtaagatcaaggacttcttttgccctttgttgcgctccttttcctaagggcagagcacaaagtcgcacaaaaccaaggtctctccactgcctgtctgtgcccagggtgccaagcagcctggcttcccacaggccaaaagaatccctcctccccaggtgcctctacacaagaggtcccccaaacccaaaggctcacagaaccatccactaacagatcaactcgcagaagattccattcctttgtcgctcaaacactgcacccagattgttactgttaattaagttaaaatattgaaaataatggttgcccttcatacatattaagtgtggaaatatgtttttcttagcagagagcctataaaagcagtggcaagacagcctagcctgcgagggcaccatggggtggcccagaaactggagtctctgggaggtgatttataagaggcgagacagggagatgaattatggtggaaggagtttgcagcttcttcataaaaatcctggtgcttggcaattatgaggcgcaaaaccagagggcggattaatgcaaagtgtcctttggttgccattttgctagtttatgttctatcgagtttgactgtttctgcccagccccaaatcttatgtggcgtcctgcttgccgggtcccagggcactgaaatcagaggcacctcagtcctttggtttctttaatggcacccttgggattcagctccaggccttgcctgagacatggtgattctagagcaatcagctgtctcttctggggaggaagccagtggtggagaaagtgtgtttagggagcctgccgtatctcttctggatttccatgggtacccctgaagaaggggggctggggccagccttggctctgctaaggacccgggccactgggcctgtggcagcctgccccagacagagcatgtgggtccagaggccacgtgaccaaccagagaaccgattcatgtctctctgtccctattagagccttgatctcagactggagggatgtggaagacccatttcatcatctccttgggttagagagaaacgaatgactgcacaagatactcagaaccccttgacatctaaagtaaagggcacgaggagccaggtctggcggcccacttttccggaggccccactgcctgggttctgttaagcctgccctgttttcttctgggttcttgagtggcagcagctcgggtgagccttccacgagcagcatcttctttcccactctgggcatttgctcccacagcatcccctccttctctctgaagacccccagctcggctcacccttcccctgtaggcttctgacccatgccagcccgtgaagacctcgccctccatggagctcagcactcaccatcagtggcgcttgctgggcaattaatcatgtcctgtctcgtgccatctcccttgttttctatcttagtgaatttttcatatgtttgtaccttggctcctaagcctcctccttgaagacagaggttcctcagatctccttgtatgcctggcctctcacccagggtggccctttgtactgcagagatgctcagcaaatgtttattggtttgttaattgaaaatctctcccgaaggccaggcaggggtgggaaaaggtgtcgcttgtgggagccgctgtcacttttgagtggtgttagggaggagtgaaggtagaggagcggcagctggagtttggggtgagcttgggtccaggtcttccatgctgtcctcaacatggctggcatagctgattaaatgtgggcttatcgaagggacacttgtcccttagactgaggccacctcagtgctgaataaggttctgagtcacctgggctacacgggggaaccaggcagcctgggggatttcctacccgaatcttctggagctcactgtgggtgaagatgggaacgaaggcttctgtctgggaggccagcatggcagccacgtgcaccaccagcagagcagccacggcctttcgggacaccatcctagggctggacagtgacaagaagctccgtcattgggttcaggtgcacaccctgcctgcagctgtgacctggagcgagccgccgagcctctcctgatgtggataggctgcggggctttactggagttccgagccccttctgtgccagagccaggggaggtgagcgagcacccgggagaggcggcctgggccctgccactggctgggtgagaagtgttctacatgttgggccccctctttgttacaggtcaggtcttccaaggccagcagggctcctgaagtgggaaggactccatgtttcagaagaaagactagattatccacagaattgtgccccaattgagcccttctgctccctgggctgatcgggatgacaaaagagatggacgcaggctcagatgaccctggctgtccccgagagcaccagataaggacactgggtctggaaagaaaggggctggaaacttctccccagatggaggcagagtcaaatggaaagttccaggaggaaacagcacccaagagctggaagcagggtctctacccctatgggggccagccctgggtctggaacaagattctcctgagctccagctagctgcatgttggtctagaaagagggagtgcatcctttccctgcgcccactccctgcacagctgagaatgccaccagtgctgggggtgcctgcgtgcatgcatggggcctcctgtgtctcaggaagtgggaatgtctggaatgtggatagaaaggtgggctgtggacccctgccggggaacagaagggggtggtgaccccaggagtgcaaaagcttaaaaaataggctcagttgggccgaatttgggctggtcaggatggtcctgtggtgggggttgggggaggagggtactgcccactgggtgcctgtctcagttgattccttaccctggtgcatggagtcctcttccaagccctgtcccacaccatccttgccctcacctgggagcaggtgcaatctggggaggggaggagacctagacaggcgaaggggactcattcagaggtggtaggggctggaagtctggccttctgaggcctgctgctcggccctgcaccccactctgcattgcctctgcacgcagaaggcggggaagggcatggcgggggcagcctgttgaatactattggagcacccacattcctgtggcgagtgggctgctgagcgcagggccaggcaccagagcaaggaggggaggccaggggcagccctgccgtggcaggagtggggtgactaaaaggttgcagaggaagagcttcagaggagtcagctcggggctcccacagccatggggcagcctggattctgttaataggagagggtcctgccctggactagcctccaagcttctcataggtccaaccccagttacccctgtggagagaatcttccaaggctgtgggcttgcaatcggcctctcctctgagacccttctcctgggtcatctgaagccacctctactaagcacctccctaagtcccctccctttgccttctttcgatccttccatccccatcctactttttctctccatctggctaatactccatgagaaagcatatgagagcatgacagccaaagcttctcatgccagctacatatgatttcctagtaaggtcagaagactgccctccctctgaagaccacctctcgggaagccaagaccctgtccaggagcccaggaggatctggaacagaacagaggatgggcggagtggagggctcccgatcatgattccccctcctgttcctgtcttttccttgtggagtctgtggggccccgatttccctcccagtggagatggatgtgtcacatttatggcatcccatttccttcatggagatgctatagagcccttttcattctgatgttcagatttaattcacttcataagaatcaataaaaactttaaataaaaaaaaggcaaaatccaattgctgctcattttcttgatccaactggcagttggcatgtcacctacattcatttgtgtgcctgggagctcggagtgggagagcttttcactgtacgatgagatactgacttccttttctatctccagggatggggctccagccttcaagccatcagctctggatggggggcgcctgccccctccctcctctcccacagtagcacaggctccctaggcaccagcttaactgctaactttccagagagaagcctccgtgccgaatagggtcctgtgtccatgctgggctctggcttgggttcctggcctgtagtcaatggcaccatgcaccccagacagcctctcctttgccagaattgtacccaccgctcctccatccagcttctgtgcccaggaaagtcctgcttttgctcacactctgtgtggctttaacctgctcctctggaaatcagctcagcactttcagccttagcctagctaagtatttgaaggtggctgaggggcatagatgtgatctctggactgggctgggctggctctggtcacatcactgttctgtcctgggtcttatgctaaccgccccctcacccccttctgtagctactcacagcagcacgtcggagcagggctggcggaggtggtctctgctgtcctctgctctctggcagatctgaccggtctttatatctggtgactggctggtctgatgggccctcgggccctcccttaggagcccgttaacctttggccaccccttgggggctttgggtggagagcctggattcttgaagctcatggaaacaacgggcaggacctgccacgccgtggacttctggggctttcctggaaggcctctgcctcggacaacagtccaggtttggtggaggccaactcccacccagatggcactttgtgggccacttagaactcagctgccactcagagggtcattttaacaaaagccctttcttttttgttacttaaatatatgatgttgttgagcggctctggaccagctctttagtgatcaggttctcagttagcatgtcagggagagtgctgtattagaaagatagcttgtcttcaccctcacccccaccctaaagcccctcacaaaagaaagaaagggctcaggggtgtgtggcagtttcaatcaactactgaaaagaaaatgcagtccagactcaaggctgtggagcaccagaggctctgtgggagccaaggaacagtgtaaggtgtgtgagacagaaggtttatgggtttgtagcccaatggggaagaggagccgccaatctgggaacatctcatggtattgcgtaattcaaatgaccaactgaaaaattttaagagggaaggggtgggacgcctgggttgctcagtggttgagcatctgcctttggctcaggtcgaaatcccaaggtcctgggatcaagtcctgcattgggttccctgcatggagcctgcttctccctctgcctatgtctctgcctctctttccgtgtctctcatgaataaataagtaaaatattaaaaaaaataaagagggaaggggtgaatgtaatcaggagtcaggcagggcttgcagctgcagccggccagtgccatttctggaacatggttgtgtctctggcaccactcagggaatgcttgacatgcatgttctaattaagcctcaacagtgccatgacactggtgctcctgtatctcccattttacagataaggaaactgaggcacaattaaatagctcctctgtgactcaactgcaagatcactctttctcttttttttaaagtaagttccaaccactatgtgggtctcaaattcactaccctgagagttgcatgctctaccaactgagccaaccaggcactcccaaggtctctttacacaagagtcaaggctggatatggccaaatgtggcagtgggtgggagtgggggcttctgggatgcagggcacatacagatgtgcaaaggatggcacagggtggggccatccctggaagtcccctgtgtgggttgggagagggtcgttccagggtctgaatgtggggggtttaatgaggggagaaattggggccctcatggtgcctggaaggggcttttcatgataatcgtgtcatgctggaaggtcacgcagtgactgtactagggtacagtcacgggggcaaggtgaatggaggctgggaggtgtctcagacagaccgcgaggtccagagggtctgggctagcagaggctatttccccaggtgaaccttgctggccattagcacctttcacagaggctgctccagacatccaggtggggactgcttctggtccaggaacccctcccctgtcagtcctttagtcggctgtggcttttctttcagaaaaaaaacaaatgtttgcagtgcttcaaacccaacccacataacctctaaataccctgctcatcaaggcttcttgccagcagggtctctgcattccactccaacaccaggtcaaagctcccccagcactctggaccgccaactgttgttgggcatgtgccctgggtctctgcagtctttgagatttatctcagaggaattagagcctgaaatgccgggacttggaactgagatgccatccccactctgccccaggttgcaagagtggcttttaagatgtcgtcacagaccttggtggggacaaggtggtgtgagggctgtgaaggagcccactgccttcccaggctccaggaggctccatctgcaccacggatttctaggggcaggcgtgggagggaaaagggtcgatatctgtacctctaacacatagaccagggaccaaatccagcttgtgagctaagagttgtttatagattttttaataatttaaaaaattagaaagagaagaatatttggtgacatgtgaatttagaagacattcaaattcttgtggccataaacaaagttcattggaatatggccactctcattcatttgtttgttgtctgcggctgcttctgggctacaagcaagggagttgaatagttggaccgaaacattaagacccacaaagctgaaaatacttattatttgggacttaaaaaaaaaatatatatatatatattcattcattcattcattcatgagagagacagagacacaggcagagggagaagtaggctccctgcggggagccggatgtgagacttgatcccaagacttgggatcccagcctgagccaaaggcagatgctcaactgctgaaccacccactgaccccttatttgggtcttctagagaaaatttgcttacccctggcctcaacagtatctggagtgtggaaggtgcttgttatgtaaaaaataacagccagacatcctacggatcagctttttaaaatctcacaacagggatccctgggtggcgcagcggtttagcgcctgcctttggcccagggcgcgatcctggagatccgggatcgaatcccacgtcaggctcccggtgcatggagcctgcttctccctctgcctgtgtctctgcctctctctctctctcactgtgtgcctatcataaataaataaaaaaataaaataaaataaaatctcacaacaccattgaggctggtgtgatatcatcctattctacaggtgggaagactgaggtgaaacaatgagcccaaggtcacagtgattaaaatggcagggccaagattcaaagaatccagattcagagtcccctgtgctttttttgccacttggtgtttgttgcatgactacatggatgtctatggcaggggaaggcccttttaatagtaccccatggaaattctgcaaacctgccactttctcataagccagccccccacaaggcatctgagcatgacccattcgagctgaccgactggatgacaacacaggttgtttttgttctcagaggaggactgctgatggtggaccaggccgcctgccaagcacaaagggaaagtcgaatcctctccctgtcacccctctatcccaggttctgagaccagtaccctgtctgttgggccagtccaggctctagtccagagacactctgtctgagaaatgataagaatctcggtacccgagacaggcctgtgatgagagatgggaagaagggaggggctgggaacagtaaataatccgggatcaattttctgggcgagaatagcattatcctggagctttcctgtgattcagtacttttgatccaagcaatgtgccatatttcagtctgatatctgcagtttggtccagaaggaaggcaaatcagggttcacagtgagctgttccttgtaactcagaggaaaacgtggagcagaggggtgctctgctgtggcctctgctctggagtcacgagctgcaaggatgaaggggcctctcccttgtgcccctcttggctgtgggtcttgaggcccagccctttaggaaacatctcaccagaagaatatcctgtctcctctctgtcaggtgccttgatcctcgaggtacattttcttctgtcacagatagtgcttcagaaaaggagagatgggtgcataacaagcctaataacggctactttgcctttaccatgtacaccgtctcgccctacaaatgctcaattagtggctatttctcctgcgaggaataaataattggccaaaaataaaaggaaggcataatctgatgttctccattctccaaaagggaaccgctatggatgtgcaatggcttaagcagaggggaggcaaaaaacctaacccaagtctgagaaaggaagttcacaaaactcagaggaaatgactcaaaccacatgtggccacttgattgcctctctcccccatgttgggcagaagtattagcagtttagctctcctctcttcatgaccttgaaaatattgtttgctgggcactgccataacatcttcattaatggcctggaacagggaggcaacggcatgttaattaaatttgcagatgatactaaattgggagatgtagcaaacatcagggaggacagagccctaatacaagaagacgtcgggaggttagaactacaagctggaaaagtccagatgaactgctggacatatgtcatccaggccccgaggacacgagatgaggatgtgggtcgtggggagaggccagcaaagaaggaaagcggcaactggggtgacctggggtggggtgggggacatggtggtgcacacatcaccctgtttaccagatgattccctcaaagaggcagaggacggtggctagaagaaggcagagctcagatgagtcaaaattgccccaaagttgctgggaatgccaaaacttgaggtataaaaatgaaaaatgaaaggtttcaaaagaccggcttgtccagaatgctggtaaggtttaattgtgcgattgctaatgttgagcagaggccaaggagaagcaaagaacaccgccctgcctgagtgtcaagtgcaggagcagcggagggagaggggcggggtagccgtggctcctcctccaggcgcccttcctggagctagaggtgtgtgaccccaccccttaccagcagaaatattagttgatggtgatggcgtttaaaactagagcaagcaaagcactgagagatgtattttaggcaacaacatgccccggcccatcggacacatgctttggtgacctgtggggtatttttattcttatccttcaattgctcaggatttttttcaaaagccacaaatgatttgtggagaaatgatacacagcagatgccatacaccaagagccccctggtatggaaatagtgtgagtggaaaggaaaacacgaactctgagagagtctgtccagaattaatttccaatttgttgagcttcctgtgtgttgcatctgatactcgaattaacgctcccacatctctgacttcctgttgagtccattcaatgtgcactgacaaccctggaccccaaacaatccaataaaatgctttcctgttcagctcagcatcgtggactattgacagtgtgcacagaatttggggactcggttgagttttacaatagcattcctgctgacttcccagtcaatacctctctgggtggttaatatactcctagaaatgtcccagtcactaacttgcttctgggttccctttctatttatgggggtttatcacaaaagctgctgttataaaacttcaaaaagaggtcacataactttttttccagggacaaggatgcaggtgctaagagctgaaactatgggctggactctctggtgggatctgtttttttctattcttactgttaattgagctggtgacaccaagtctccttttagttgaattttaaatatatgtatttatagttttatagagatgatggatgtgtgtgaagagaaagcagatggctttggaagtgacgaattaattatgagggaagccaaagcctctcctttctcctcaacgcttcagggctggtggctcccagcgccctgatccgagggcatgaggcattagaacaaggaggcagagacagctgacacattttcataaatgattaagggagtctgtggttgggaaaagtttgtgctttcatgtttaaggaggaaagaagtcttggtggaggttttacaccatgtggatgggaaggcaaaatcatttcgaatgtcagcccaatccagggtagattcaggtaaaaggagctagctgtccaaactttttctcttccattgcatcaatgaaccgcatctgttgacttccccatgcccactgggctgacaggttttggaactgggaggctgtcaggcgctgctaatggaaacagtgggccacacgcagcttctgccattgacaactgtggcagtcacacagacctccttcccaccagcccactctggaggcaagtggcagggcaaagacaagattctgtttcctctgtggtccatggctggggctgggtggccagggagggtctgggcaagtgtggaagacagtggaggagggcgagtttacccaggaattgagcagaaattgtttgatgctcaggtctggtgctcaggagccattcccagctccagccaccttcgtagatgtctggctgagcagagacctgatctgtcaccacagcgagcatgcttccgaggtcctgaacccttgtgatctcttgtgcggcacctctaagtgaggtatgggccaaatgagcaggtcctaaattctcgaatgggttggtagggcaagccagaggcaccatgggagccaggccagggcaacatgggcttggagagagtgatgtagacagtgcaagtcttggctactccgaccagggtcctacacaataacagccctgggcagctctgaagacagggatgatagagctcatcttcaaccccttggcagcacctggtcctccttttttcattttctgcttcctagaataatatttctcttggaaaaacaaccaagttactgagaaactgcagccaaacaacactgcgggactttgagagaatgcccccaggtcccaggcaagacccaatcatggtgataattcatctaattattattcacccagggctcatctcttgagtgtttgactgtcagatctgaattccaccccaaagaaaagctatgctcagagaagatttgcagttgttctttgtaaaaaggacagaaaaaagggagaatttatttaaaataggcacgtgtaaactcccaagggacaggaggcataaattgcaagaacagctccaatcaaacttgaatcctcctggtttagaattttactgagggggatggaatatgaaagagaaccgagtatccccactcacttccaagtcacatcaaggcagtcagcttgtgacagaaagattacctgcaggagggctttatttgatgtgaaaagggttaacgtcattttagcagattagaaattctctgggtcttttaggaatgaaaagcaaattcaaagcttttacatgaaggaatgtgcctaaacccctttttagacactagaaacaaaaggggggagtggccgggcttgctttgtgcatgaagatcatgagttttttgattctcattttaaggatggccttgtagggctgtgagtaagtaatggggggtgaggggttgagactatgttaaaagcctcagcctttgaaccaatgaatgaataacagtaactgatcacccatgcagggttcagctctgtgctaggcactgggtggggtggggcagtggacacggatgacacaagcacagcctatccctgcaggagcatatattctggttgaaaaggaaagctgacagcaaggaaccaatcaatgctgagcaccctgagatggcagtaagctctggaagactccagaggggagaacttccttaaggccagagtcatcagagagcccttccaatgccattgggatgggcgagcggcgtggtgggaaagcatccaagcctcagaaacctccactgccgtgtcaccatctctccctttcccttttttctctccccttgttgctgcatccttctggcctcagcacctccccacaccccacctccaccctctccagagactgaagacacatttcaggccagccgtgttattggatttaaatgatgctatggctttttaattcttgctttaattgcctttccatgcagggcactgaggatggttgattaccaggcaactgggcctggcggtgacattctttatctgatgttccttcaagctgcagtgaaagggacatcctccagggcctcaagtgtggacttttctttggcctcgccctcagcatcctccagcctccagcctgtggcagctcgggcccagggctctgtccgtggtgctaaggatcccaggctgccccacttaatcaggctcccccgccaccccacggcactctttgctccagctttggaacttggagggctgaataatttttttttattaaaaaagttttttttttttttttttttttttttgagagagagaaaaggaggcaggggttggggcagagggacagggagggagagaatcccaggcaggctccaagctcagtgcccaatctgacatggcaatggatgccacgaccctgagaccattacctgaaccaaaataaagaactggatgcttaaccaactgagccacccagacagccctggaggacctaataatttaaacaaatggatatatttccctttcccttatgggcagcaaaacattccctgctgcatctctggaacaattacccctcattcagtgtactcagcaaccctgctgggagctaggagagcaagagaggagtgtgggcagcctctgctgtggtgttcccactgtgggtggggcctgccattagtacacaagagagaggagccccgagaagaagagccagctctggtggtcatgctcagccctctttcccccagcctctggctttgtcaagctctttgggagacagtaggtccaatttgtcccctatcattgatgacaggcccagcactgtgccaagaagaagatcttactttgtcctaaaacacagctgcttagcgaggccaggctgtcacagagagcagcaccacacagacccacgcaggcagatgctgcgtggggatgagagggctcattaaaggatgaaacaatctgggtgtggtgctaactatgctggtgggcagcagacctttccttcaccctccaactcacaagctgctgtctccaaggtcctgtaggaccccttcaggcctgagtccagcttgaagctgtagtccaacttgtcaattgagatgaaagaatgaacactaggggtaatatcactcccagtcagggctggaccagccaaaaaacctgtagaagggcaaccccactagttcacaagtagttaattagcacaccctaaaggtaaaacctttatgttcctgatgaatcagatgtactcgatgaaatctctaacataaagaataaagatatgtttcagattccaagtttcttgagatggagaagacctctggggaacaagatgaagctccactagagcacctgctagcatggcctcatggggctccaatcaatggcatctcccttctcaggagaccccaggcccctatttttcccttaaaaaccctcactgacaagcccctggaggagtttgggacttttgagcactagtttcccgttcctctgagtggcaccacaccaataaatagcctgtatttcttcactgcagtggagtatcagttttattgacttactgtgcactgggtggacaaattcttacttgattcagttataagcttaggttcccggaggggtgcccatgccccacctccacttggcccctgttctatcctgctggctgactctctgggtttctgtcttgtctccaaatgttcttcacttcctctctcttctgttgtacagcttctcattgagtagctacgtctgatgaacccctgtccacagttgtcagccacttctttctcctcttttcagccccctctccccaccaacttaatccacttgaaatccttctgtagtcatttgatccatggtcacagtcaatgacgaagggactgagtgtccataaggaacaggaatgtagtccatctccttgggggctcaactctctctgggacagaggtgggcaggaggaccaggtccaggccgggggtggggggcaggagaggctgtttctagagagccaaggaggccactatctcttcaccaagcttgtggaggccatctctaatgtgtgtcttctctaactgcaccaagaaattctgtgacaccagctggtgtccttcaatttaactcaattctgacactatctacctagagggctcagtcccacaagactgccttcatttcagatactaatcagaagtccaggttgtgacttgtgcttctgactggctggcaataaattgtagattccccatgagcctctcctaaggtttgtttacgttgttcatagaagtcagcttctgtgactggtaagcttatgtttaccagtttattatgaaggatacagataaacagccaaataaagagatgtgcaggatgggatctggaagggtcccaagcacagaaccttctctttccaaggacctgggggtacatcacccttttggcatgtggatgtgttcccaactcagaagctctctgaaccccgtccttctgcattttttataggagtttcagtggcaccattgattaaatcattggccagtagggactgaactcaatctccagcaacctctccctttccttggaggtggaggaagggggctgaatattccaatcatcttagtcaagtgattggttcactttggcaacaagccaccacccttaggtgcttttcaaaagtcaccttattaacgtaaacccaggtgcattagaaaggggcttgttgtcaataacaagacactccttttattttcattgctcaggagctatttcaggaaccagaaaacaaacattaacaaaagatgccccagttgctctcctcacttgggaaattccaaggatttaggagctctaagccaggaaagaggaagaccaactatgtatttcttattataaattccattatcactccaccattagggagcactctcctaaggacaatttggtggtgtggaggggcagagacaagagctccctccaacccagactatctaagctggagaggaagatgaggaggcctagagactggagggaagccacagcaagagggaactcaggagccagcagaatgggagtactgacattaagcctcacaacctgacactgcctgtgtcccccctaccatcactacactgtcattgtcagagtgtgggtgtgacaggctccacctggcagtcccactttcattgtcatcattttttaaaaagattttgtttatttattcatgagagacacagagagaggcagagacacaggcagagggagaagcaggctccctgtggggagtccgtgtggtactggatccctggactgggatcacaccttgagctgaaggcagatgctcaaccactgagccacctaggcattccatcatccccagcattttaattagctgatgtaacatttcccccagaacatagggttgattatttcccccacttgatttcctagggtttgtctcttcattgtttttcttcttaaaagaataaagccaaagataagcacctcttttatgcttttgctgaaatattgctgctgttggtgaagggggtgggtggtgatagagaaggtgcatttgggtgaagggatacagagggaccagattcctgtgcccagtgagggtgagccctgcttctagaagaagcaccccctggaagatgctaagtctgggtggggtatgactggctttggagggtgcacccttggggaaagcaggcctgttccataagctaccttgacaacactgtagctctgagactgtgctgaccctgaaggctggatttagggtcacctatctcagttgactagagcatgacctgggcacctactagacacaagattaactctcttaccccatccttccctccagcatcgaaagtgaattgagtaaggactgtgggtagcagggatcatgagacatctctcctatgacaggaaagagcttgaccatgttctagaaactgagtaggtcagcatgtgtggagtgaacccaggaggtagctggtgggaagtggataaactgggggtgaggagaaggcaagagctggatcatgcagtgcttgaaggccacctggggatatttatcgtgatttggctgtccagcatccaccccttcctccctgttggggcagtgagaggaatctggtcagattctctcttggctgaatttgcttggccaatttctccctcctgccctggactttgagtctcaagtagccaaagatgggaagaaagtcagtctctctctggggtagtgatggggaatgtggggcctagcagccttgagtgtgttctgtcctggccattgatgccaaaaatgtttcttgcctgttttccacacctagagtcttccgtcatcaattctgaggcctgatattccccagaagagccttcttttctcatactagacagaaaaggtggtattacatatggatgagtacaacttgactgatcctggatgggagtctggattcaaatggcatgcctttgaggggttttaggcagggatctttattctttctttctttctttttttaagacaaaaagagagtgtgtacgtgcacatgagggagggaggggcagagggggagagagagagagagaactttaagcaggccctttgcacaacatggtgcctggcatgggtcttctatctcacaatcctgagaccatgacctgagccgaaatcaagagtcagatgctcaaccaactgggcaacccagtcactccaagtagggattttatttatttattcatttttaaaaagatttttaatttatttatttgagagagagagtgcacacttgagagagagcatgagcagggggagggcagaaggaaagagagaagcagattcccccctgagcagggatacctatgtggggcctgatcccaggaccccaggatcatgaaccaagacaaaggcagacacccaactgactgagccactgaggcaccccgacagggaacttttaaaagatccttctggatgctgcatggagagtgggttatggggaggcaggaaaagaagcagggataccatcttggaagctataggccagatgggagatgatggcagcagggaaaccaagaactcaagatctatatacttggagatggcttcaatgatgatggatagatgctaaaaggaatcaaggatgctgcttagatgcctgggtggctcagtaggttaagtgtctaccttcgactcccatcatggtcctggagtcctgggatcatgcctggcttcctgctcagtggggcgtctgcttctccttctgcccctcccccactcattctctttctcagataaataaaatctttttttaaataaaaggattgtgctgaggtttctgacttggatactgtgtgggcagtcctgaagaggactgaggacagaggagattcgtgttggggcaggtggaatcaacagtttcatgttgcacattttaagtgtgagcagctatggtcagtgacagtctaagcaggaaaacagaacttttgccaggtagttcaatggagggaacacaatatgcagaatgagctaaaacaggaagtgggaaacggggatctgctccttctcccccactcctcccacagccccgcccccaggatagaggtcctggggtatgagcccaggacctgaggctgcctggtgggagctaggatgtgggcaagaggctgcccaaagggtctcccaggctggggaggctgaggccacggcagagatgtggccactgccaaataagcagcctctggcagagacaccacaaatcagagagaggaaagaaataccctggcttctcctcttctccctcctacgggtctctaaccattggctgaatctgattggaagccagctggccaggagccttggaaatgtcgctttctgggggcagctgctgtgatccagagaggagcaggagtgcaggcgaagcaggcagaggtcagacagatgtctgccagaaatcacagtgacaggttaactagtcttctcccagaaattatctgtatttctaacgtgcctttctcaaaggaataaatcactggggaggggattcaagcccacaggacaggtgagctgggggacccaagaatctctcctagtttccccacagagagactgaatgtgacctatcccatctgggatggatccaccttggaagtcagaaccagccttgctcacattctaagaaagcgcttctgctcgccggctgctcccagcctccgtgtccaacatccttctgcttttctgcagggacaaggaaacagccgacttgtcagaaacctgcctccaggataaagagaaggaggagaaatgtgactaggaaagtcatcaaatggtgatgacagctgctgcttaatatggaaaggggatcctaattattgcttggacaagcagggaagtaagaagtccatcagccaaggtggagggcaaacaggcgagtcagggcaggctgcctcctgctaagaacactggatcccttcacaaaggtggacaaatgagttgctggtgaccgaaggcacctgagccactcactctcgacctctggttccaccgaggagcacgggtggcgtggaggtggggcggaaggcctagagcagcattctggctgcagcaggagagtggggctttgggacagccttgtgcaagctgccacacctctccctttgggccttcagttttctccgccttgttaaccagatgtcccctgcttctctggtctacagagactggacttcctgcaacgcccagaccacaggctcggagccctcccgttgtgtgcaggaagcccagtcttgcccaggttcccctccaaatgctccagcatctcactccagatgacagctcttcctggggtctgctgtctctgcctcatgtgggcattttcaggccaattccttccttctcaaactccttccctccagctgggatacagttctaattctcataattcccaaagcctggctatgagtaggctctgggatctaaacaagctttacttggggcttagccagcccctctccctctccctcagggtgattctcgtcttagcttggatctgatgctacagacctgctcataccctcaatgagaatgccatcggccacagcctgtgacccagagccgaggaccccaacctctgctgggctcagagagagaggtcaccttgcttctgaaaccatgcacttctcatcaaatccatcttgtctagtcaagaataagagtttggctgcactttgatacaaaaagactctaccgaattattttgcccagaacaaacgagctctttctacactatggatcagagaattgctgacggctttgattgtagaagcttgttcccacttctggccatcgaggctgcagaaatactggggtttggcctggttagagccccttttcatgtgaataatggggatcatcaggtctgcctggctgggacattctgagtattaaatacatattggatacaaagagtccgggaaatatggtaggtgttcaatacatgctgaggtgttctctccatcttggctcaggtacttcaacagcattacaaggagctggggaaaagaaggctgtactggagggtttgagttgtccctctcaactctctgaataccagagactgggagagggaggatttttctaggtgatggctggccttggaaggggccagaccaagcatggtggatgtgggttcaggtctctacttactgtggtccctggcggtcagctgtgtggaccactgagaggcacgtaaagagccgggttcatgcccagcttctctctctccctgccttgctgtgtgtcccttgggcaaggcacaacgtctctgtgtctcatattaactgccattgctgctgtagatgggcctgtgtatcttttttttttttaagattttatttatttatttataaataaatgtctctctgtgagagacacagagacacaggcagagggagaagcagaccccctacagggagcctgatgtgggactcgatcctaggacaccgggatcatgacctgagccgaaggcagatgtccaaccgctgagctgcccacatgtccctgggcctgcgtatctgattcaggtttgagttgccaacctctgcttgtggggcagagccaggcctatggggttgtgtgaaccgagggccgtgggccctgatctgtgcatggagggtttggagaagctgcccgtggttatgtgtacagatgtgtaacatcatcttgggcactgtgtccctgctgacctcctcttggaaggagtgacctcactttctcctctccctacacaccatgtggcttaattagagttcgctgaataaatgggtttatgggtgagaagtcatggtttaaaaaatgagaagatgaggggcacctgggtgggttagttggttaagtgtctgccttcagcccaggtcatgatcctggggtcctgggatgagctccgacttgggctccctacttgcaggcagtctgtttctccctctgcctctgcctctctcccactcatgctctctttctttctctctctctcaaacaaataaataaaatctttaaaaaagaaaatgattaaaggttagagaaaattagtgagggggaatagggagaaagaaactctcaggtagaaagatggtctgctagtccttagctgtaaagttacctacatgggggagagggagatggacaaggcacagcccctgcccttcagaagctcacagcaaatgatccacagtgaagggtgggctgggcaaagtctggtggacagagaggacaaagttggtgggcctcctgtggtaggtggactccctggaggaggcacatttagatgcagggtgggagcagggtgctcaaggacaggttctctcagggcctgatgagctgagaatgaggcctgtcagcaaagtgtctgggaatggggaccctgttttgggcacctagagaggaagctgactgtgtcccctgcccccccaccctctcctagtgggtctgctcctgctgcagggtggggtgcccactgtttgttactgttgttggagctttgaggtcttagatttacagctgtgttcagcataagagtgcagctcaatgcaactgaatgaatgtttctggagcatccaccatggaccccacaattggtggtcctgacccgtttgtcccctggaaatgagaagaagattttgacccagtttctggcctgagattgctccaatctgttgtgttggagggtgacttggggtggggactaagaggaaggttgcgattaaaggaaagggagacatgaaggctgagacaagctaggctccccgacttttcaagtatcaggatccctgtttgatataaaaaaactttcaacagctttgaacaccaactggatatgaccgagttaccattaagtattaagtgtgacaacggtattttgactccactttaaagcgaagtggagatgcatagtgtagtatggacagatggacccataggacatagggcgctaggatgtgtgcttcccaagaacagggaggggcgtagctggggtgtggccacaaggaacttgctctgcactttcgggtagtcttgaaattctccagaatgaagagttaaaacaaaacaaaatccagcaatcctttgaaaacaaagactttcaactgtacttgtggtagaagtgcatcactgtgtggggaaatcacagtggcaaaaatccaccctggttcaaggaggctttggatgaatttgcattctattagtcacaataggatcttttgataaatgaaaaatggacaaaacaggacacaggaggagggcaagatttagcccccccccataacctccagggtgggggagggacagggagaggaggtggaagggggaggtgggggatggggtggggaggcagggctggtgtgagacagatggtagagagtgcccctgggtggagaacagcttttggtgcactgggatacagggacagagttgtttgctgtcagcggtggctagggaaatgaggtggggtcacatgatgcagatcataggactaccaccacagtcctagggccaagccagtcctagggtcaagccgggaacttcagagcagatctgctcgtccctctccctctcgcttcctgaggcctgttgtcaccatggggcattctctgtgcttacttcctgactgccccccaacccgactccatcacctgcctggtctccagcttctctttgcttcatcccattcaatccactcccatggccacaaagatgtccttctgaaactgcagcagggttgggggctggggaactcatcttcctgcttcacaacttggagggctctccatggagacacagctacttagctccatagatagaggccatcacctgcaggccacctgctttgctctgccttccattcctccatcccccatcccagagtcctccctgcaccccaggcttggtcaggttccttaaacacgcagatactgcactcctgcaggttgggcacactgttccccttgtctggggtccttcaaggctgagcgaaaatgttcccttctctctggccgctttccctgactcctcaggtggaatagatggccacctgtgctcccatcatacctgtaaacacctctggtgcagtcccgccttctctctgttacttccgcttcactctcatcccccatttgactcttcagtgtccggacaatggggactgtgtcttattcactgaaaaatctgccctggacacagtagacacataataaatgcttgttactttggagagataattgccattcacatcatacatgaattgcttgttttcttttaaaactttgaaaatctataaataatagtgaaagggaatataagggaagggagaagaaatgtgtgggaaatatcagaaagggagacagaacgtaaagactcctaactctgggaaaggaactaggggtggtggaaggggaggagggcggggggtgggggtgaatgggtgacgggcactgaggggggcacttgacgggatgagcactgggtgttattctgtatgttggcaaattgaacaccaatacaaaataaatttattataaaaaaataaaataaaactttgaaaatcattacaaaaatcatccccagggcttttacacattcataaccctgtggaagtagataaataaaaagcaagagtccctcatacttgtctcccagtttaattccccagagtgggcctgtcaatcacagggagtagtttctctaggccagtggtcctgaaagctggcgccccaccccccagccctgcaacagcatcaacctgcgttagaaatgcaggcctgcgggagccacagccacttgaggaccaggcctagcactctctccaggtgagagccactgagaaccagcttagttagggctgaagctccgggagccagagccaccccgaacccctctggcccagacaggagggaggtacagcaggtgcagcccctatcacagacccttgcattttattttggagcaaaaccccaaagtcagctaatttccttgcctttggtctcctttagtctcagtgggtggcaaaagagagccagtgtgggctgatggccggtccccttccctggtgcggaaggggtggtggaagtgcatcactgtggcagggtgaggctctggctcggacactaacgtgctatgtgatatttggcaagttgctgtactgctcttgtctcaaaaaggcactggttctctagatattctcccgtacattaacaaacaaaaatctgtgttttgagctctcagagagcttgaagttcagataagagatttttttttaagatttattatttctttaagattttatttatttatttatttatttatttatttatttatttatttatttatttagattttattcatttattcatgagagacacacagagagaggcagagacacaggcagggggagagcaggctcctcgcaggaagcccgatgcgggactcgatcccgggaccccaggatcatgccctgagccaaagacagatgctcaatcactgagcccaggtgtcctagataagggaattttatgggcatttccaaagggaagaggcaagacgcccaaatagtattaaaggactcatttctctcctgtgcttttctgctttcccaatgaagtacaaaccactgcccaccagttgcctgtgtggcctctgtttatggatcaattagaagaaaagacccattgcatacattcaatcttcgtaaagaacgggatataacaaacatcatcccctcccatatgccaggcgctattccagatgccagggatccagcagtgaggaaaacaggcaaaaccagcctgccgggatggagtttacattctagtccggagaattaggcaatcaagaaagaactcagagacagtgtgggagaagggccatgggctacagcaggtgccgtgaacttagcgggatccagagtggcagcagctcagagtgcagagccaacaggccagggcatgatcgggcctcttctgcacagcaggagaaagggaatttccaatcgttcttcacatgagccaggggctggtgtcaggctctgtctttaaggggctctggtgtgtttacagagagagacaagactggcctcagggtcacatatgattcttccttggacaggattccatttatgagctggcttggcccgtcagggaaggctggtcaggaggttggaggattcagagtgggctgctcccaggaggcggcaccctggctgggccatgaaggatgagaaaactcccagctgcacgggagggagagttatccctgggttcatggaaaaactgtttgggaaactccttaaaaaatagaaaaatggagggacacctgggtggctcagttggttaagtgtctccttcagcttagatcatgatcccggagtcctgggaccgagccctgcatcaagctccccactgagtggggagtctgcttctccttcccctttgcttttccccttgcttgtgctctttctctctctctctctctaataaataaataaaatctttaaaaaaaaatagagaatgggtatctgtgcctttctgtagcccaccccccacacaaaaactttctctttagatttttgcccagaaacagttcttggttaggtaaggctggtgtgggaaagggaaggggagtaagagggccaaggtacagtcagagccaagggctgctcagccctccccctgcccccaccctgtgcaggaggggatgggctgccccagaccccctccttctactcaaagcccagcccctgcctgaacttggcaggtgctgtcagcacacagtgctcactaattataccctggacagatgctgagccctcatgggcctggcacctttcagggacctgcgatgtaagcctccaccctgggcagtgcattgatgggattcttttgtttttttccaggcctccccttccttttgccacaccagccttacctaaccaagaactgtttctgggcaaaaatctaaagagaaaatttttgtgtggagggtgggctacagaaaggcacagatacccgttctctatttttttttaaagattttatttatttatcagagagagagagagagagaaagagcacaagcaaggggaaaatcaaaggggaaggagaagcagactccccactcagtggggagcttgatgcagggctcggtcccaggactccgggatcatgatctaagctgaaggagacacttaaccaactgagccacccaggtgtccctccatttttctattttttaaggagtttcccaaacagtttttccatgaacccagggataactctagtcccatgcaggccccactgggaaggggaagccagtacaatgagtaagtctggtggtccagaaaggggtcgggaagatctgtgcctcagtttctgtacagttgtgttatggaactggggtgggacagtcaaggcctagcaagttctgaatcttgcactagaagggcctggcttgccagcgagctgaccaatagtgagcattttacatctgtcctgtggctcattacaggatcgaaggcaagtctgggctgcggagccctggggtgaaatatggctcaggaaaggggagtctgtgggtggcggagcttgatgaaggccactaggccattacttaaccatcctgatgggctttacactcccagtggtgacatttttgctttgattgcttaaaaaaacagagtggtacctcccccggtcatttttctgctttttcctcataaatgaaaaggcagatgtttcccagaagagttgtagctagaatctcatttctccttagtgccttgcagctcaggaggagatgagagacactgccaccccttgggcctgccctccctcccagtcccggcccctcatctccacctcagcatgctttcttggtggtctccctgctgactcctgctcagggcttctggcctgtgtctctttctctctgccttcccctcgccctccccttccatccttcccctttgtctcctctgggagtgcttccccattccctccccacctccttcctcaacccttcctcctctctcccactttccagctccctccccattttgcagatgagcaaatggagactcaaagccaaggagcacctagcttatcccctgggtggtcagggcaccaaggctgctggtcgtgtcatctgtagcatggggaggctggatgatcgtccccccagctgggttgtctgtgctgtagtgttcacctgggaagccgcaggtctggctagcgcaggcccttgctctgtggctgagcagcatcgccagctgggagctggtgagagatgcagaaccccccatgcagattcagcactttaatgctattccccctgagattcataggcacatcagagtttgcactgagcattttcaggggagggtctagatccccccagtccttcctccaggggcactgtatacccctcaggggctgcaggtgtggccacagccactgcagcaacccccgtccacccctcttctgcaccaaggaagcacgtcagggtccccaccaggctgcccagcccagagtggggccgcagtgggcacggcttggccaactgccctggttctcttgttgcttagttaggtcttgataaataatggcttggagacagctggaaaccataacctggcattagcggctgggcccttccacctctttccttccactgaggtaggcctcggtgggcagctgtggcctgggccaagcccactgtggtggggagggccgtgggagcctagcagaggcaggatgtgaaggagctgggatcctgctgtgtggtgagcctcccaagtcagctgctctggcccgagcctcaggcctccccacgaggttctgagagctgccctgggaagagaggtcattggtttctgggaagcccatggggcagggtgctcccagcccccgtggctagtgtccgggctcgaaacatggctgtctctcccaatcgaagcccctcatttgacaggaagaaacaggtccagtgcagggaagggactcggttaaggtcacacagcttgtccttggacataaatagcaaccccagtcaggacagaagtgattcagctcccaaatcctggagtcatcctttgactcacctccttccctcacacgccctgtagcagattagtgatggccaaaaattctccacttctcctcccactgaaaggtgaaggcggtagctaatcaccttcctcttgagtcagggccggcacggtgtcatgtgaccaatagaaggtggtggaatgagattctaggactagatgcttgatcacaagaggcttccaccttggtttgtcggaacacttgctcttgtcaccagctgctcgttatgagaaagaagcctggagcacctgggagaggcctgtgggaagaggaatagaccttgggccacctgcctgggacaagctcccagccgctgtcacacacactggctgtgcctgagctgtcttggaggtggctctggtagctcctgtcaggctgccccggccggtgtcacatggaacacatgagccttcctcattgaaccctgccaaattgcagactcatgagcaaaataaattagtgtggttgttttaagccaccaagtattgggggtggtttgttatgtggaaatagacaactggaatgcaccctgaatcaatctgtcagctttgccttctaaatatatctagaatccaacctccataatctcttacttggaagattacaatagtctcctgatggatgggtcttcctgcctctggtccctggccccctacaatctgttctgctaaaacagaagtcagatcaggcccttctgcttgaaccctccccaggctccacagtccactcagagtgagaggtgaagtactttccacatccagcaatccctgcaggatcagatgccacttacgtccctgtcctcgcctcctcctgtctcctggactccctctattgcagccactgggcttgttagttttcgaccattcaaagttcactctggccccaggatctttgcatctactgcttttcttgagcctgcatcccatcgcttgcagataccctgctagcccactccctcatttcatttagatctctagtcaaattttccagagggactttcctgatcacactacatcaagcagcatccctatccttcccctgctcccttatccttatctttctccatagcacatagcactggcgatctacatgtttattttattacccctctttcccgactggaacacagtctccttgtggaggggagggggttgtctgtctgcgtcactgctgaatccccagcacccagctcagcttatggcctgccgtgggtgctcagaacatatttgtgggtggaggaatgcatgagagctgacctggggagcctgggggccctgagggtcctggggtgctggcagggctcctgcctttctcctgcaaacttcgcttcccaggggcccttgctgtgggcttctggttctggaggaagcacagggggctcccaggccacacgctgcacccctccccctcaggtcctcccacctcctcagcacccagtgtctccctttgggcctccctcacacttgcccctgccccttgaatggcttcctccagtctctgctgcttgttgaaatctcacctggctcagctggccacctgggatttcatgaaggcttctggaaaacagagcgagttaagtgcctggctgcaaagtgaggctgttttggggggagcccaccccagaactctctgcgctgtctgtagccagatcaggcccagatgattttcctccctgctcagctcagcatccctggctcccccagccttgcctctcctcccatgcagcattttcttccgcaagtcccaggcttggtacagctggcacccgtggggccgctcctctcacctggagacagcgccaggccccgtgccacgttaagaggcctcacttggcactgcagctcccagctctcccccagaatgtctgcacccacattaacatgtctgacatcctttcagccacatacggcggctggaggacctgcttgcagctacttctatctcagagatgaagtctgcagggcacaggaagagaaccttagccctgagtctcaaaaagtattttctatttggctctggaacctggttctgctcttcgtctgcctgcaggaggccttgggagagcctcgagcccgaagctgtgctgtgaaaacctgagggagggggacagagtcccacctttaggtgctgaggaggcggcaccacttggtcacgtcaaatccaagattccattcatttaaagagtggcggctgtcgtaggtaccatgaaaggggggaaatgctgctgattaaaccaggaggcgccatcaataactagacggaccttagtttcagcgatattaaaatgtgagagcaaatgtgcatctttgataaaatacggttgtgatggaggtggaacggccccttcctctctaagctaggcgctctctggctcacaccttccctggaaaggaaggaatggaagggttgcctctgatccaaaggctttggctcccacccttgccaggggtgtctgtgagaagaaccagagatgggggtgatatcaacagagggctgggggggggtgtgggaagctgagaaggggatcctggcagtagagagtggaaatgaatctaccacctacagagcctgttgaataataaagtcacaagcccagccaccgtcttgtcagcccagagcaaaacagatggcctcagcccctgtccccccatctgagtcatggaggagtagcaggcgcagtgactgtcctaacccctcccccgggttactcagctccctgctgctcagagatgctctctgcctgggggaaggaaggagaaggggtgctggagggagcctcctccttggatttctgggagggaaacctaagtctgcaatggggagtcatcatcaccagtccagggagatggggtgatgtgggaaggacagacgagggagcagggcccagaaacacgaggggaacatctggctgcagtgggagggactggagtttgacctgcaggaggaaagggatcctttgccggctgaagggaccctccttccccaaggttaccccattttcccgaggcagcttgcatccagtgactggtaaatgcacagcataagggaaggtcctccaggcctcctgggcggctgcctgcaggaccatcccctactggcagctcctggggatgggggtcggggtgggggaagccaaggcttttgctgtgcctgcctcagggcccagttctgtaccctgccccatcttacctccttcgctcccccatgggtcctgtctccaggaaacccacacatgaccctccagctcagagtctgtttcccaggaacctgacctgtcgcatttggagtaaacaagatggagcagtgagtggttgcagggagtcccactctgaagctggcaggtgccccagacaacccctggagactcctcccaagcctatgggtcctctgggtaggagggagctctcagtggctcccctgggagttctccacatcagcccatggtccctgcccacccacaaggccagaggagaggcaacagatctgggaaccatgtgtctggaccatggcaggggcaggggatgcagatagagcccaagagggggtgcgggggtgagggggtggctaggggatatttggcaggtgatacaggctctgagggccccaagtgaggctgtgggcagtggaccccccctatctgagtacagagcagagcatatttgagctgtatacaaagctgggttggccagtacaagactacatatgattgcatgtgtaggagagtgggcacaaaaatgtgtgtgtgcatgtggaggtatgagaaagtgtgtgtgtgcttacacctggcatgtaagcatgtggttatgagtgcgcacggctgagtatgtgcccgtaggcatgagtgtatgcaaacaggcccgtgtgtttatcgatgtgcctatgtgtgggtacagacaactcatggaggcgactcatcctctgtttcatctcccttaccagcttcagccttcctgtcttgcctcagatcctctgcctaagctgtcttaagaccagctcttccttcctaagtcttcgcctcctccaggaagactaccttggtgaagatgacacaattgccgagccatcctttcttgtgttttttctcaccggaacaatttacctgtggattcagctccatgtatttgtctgtatcccaccatcagactgggaggtttccaagcctgggaacagcctttccccaatggccaggatctccccaaagatgggaactggaatcctaactgccttccagactgtgcttcataagccccactgctaaggccctgagagaagtggagggctggggacctcactccctcgcaccaagcccagtctcctttctggatgacctatgtgggtagttcagcagaaggagctacaggctaggcattgggacagttgtgttctcatcttgactcagtgtgacttgggaaaaacgcctgttttctgggtcctgagtgcctcatttgtaacgtaggtggttagacaggtggtcccagggcacctcatggccctgccctctgccaacacagctctggtgtcctacagacccgtgcagccccttgttcctccccctgaccccagtccacctctctgtcctcactttaagctggtcaattgacctggcggccagcagtgccagccccctcagccatgcagagggtatggagagggtcactgtgggccacacgtcctgtgttattacattgagtaagctgacaaaagccatcagaagataaatcatttaataggagattaaaaaccaatgagagcagctggggttctgacccagagtctctgcgtttttaatttaatttcttttgctgctcaaatcacaacattctaaaatgatagaagtagctgtgtttgctcatgggttttatcattaattgatttggctgaggttttcccataagcttcatcttttggaacatgcttctcattttaagcctctggactgagcaaggaggggaagtgcaagatatgtgggaactggagtgggcgcgaagggtctgcccttggcaaacacctccccgggggcagtgggtcctggaccagtgcagaagcctggtggcagcttggtggcgttgctgcctcagcatccagagcaggcaactcacagccttcggtctaagaggccagaggctgggcatcaggtgacgctgggcaggctggggggggcggggcgggggaggggggtgccccggcggggctggtttccggccaggcgggcctcacccccacggctgcgcaggtcagtggcggccggagcccacgcgcgtgtccccccgctgcccgtctccattgggcccttcccctggacaggagcccagggctgcccggggccaggccccagctctgacagccgctggtcagggcttgggccgcgcgatcggagaagccctcacggaagagggacagtacgagtcggcaatacacgtgctgtttaatttctgtttctaggtggtaacctacgggcctgaagcacgaggacgagggttccgttatcagagcccttttggtggcacgtgaggggccgccgcctggagcccaggcaggcgggagggaagccgttacttggcgaccccaagggcgggccggcgcgggacccgtccccgccctcagccctgtcccgggtcgggcggctccatccccccgaggctgcggcaggaaagaccgctccaggcccggggacctcgcgggagctctgattggcccagcttggggcacatgctcaccccgggccaatcgccgtggcctgtgggcgggatcagctcccactgccctcctgcttcctccagcagagcaggctcccgagttaggcgtcctgttcctgggggcgagggagtccagcttccctgtcaaaccactgtcacatttggatgcggttcctaccaagtttcccttctcaaggcaaacgccccgtagaagagaaggcgtgtaatggaagaggaaaccgagtaggacccacgtgtggcaagatgccgggcaccgcaaccagggcgtgcgctccagagcccctgggacacggctcctacccaccgactgacaaaatgaaatctctggggacactgggtgactcagcggttgagcgttcgcttttggctcaggtcgtgatcccggggtcctgggatccagtcccacgtcgggctccctgcacggagcctgctgctccctctgcctgtgtctctgcctgtctctgtgtgtgtctctcatgaataaataaataagatctttttttttttttaatgaaatgtctctacatccaggatatgggaaacagaaacactccactcttggtatcactgcttgggagcacaaggtagcagcgccctgggaaggggaaggtgggcatgccctgcaccccaactgcactttggggtgtaaatcccagagccagtctcactcgtgtgcacaaggaaacctaagagctacagtctgttctgtgtgtgtgtgtgtgtgtgtggtttggagagagagagagagtgactgtgggggagggcagagggagagagagaatctccaacaggtgagattctactctctgtgaactcctacccagggctccatctcacaactgaggatcaccacctgagccaaaaccaagactccgacacttaatccattgagccacccatggaccccagagctgcagcattttttggggaaaaatgttgtccatagtctcagcatttattaaccagagaaaggataaataacgtgtgggatacataaatggtgttcttgacaagaattaaaattaatgtttcatgttaccaagacggattaagtgcataaacattgttgattgaaaaaagcaactcccagaaagtcttgttctatttaagaagctgtaaaactgaacaaatattatatattacttatagatacacacgagtggtatgtatgtttaaaatcatgcatgggaatgacaccaacttagggtggctacttttggagagggaagaggctatgtaaggaactgggagaaatatacaaaggatttcaattgtatgtgtaatgctttatttcttaaaaaatgatctaaaacaaaatttaaaaaggggctcattctgtgtgtgtgtgtgtgtgtttgtgtgcatatctgtgatgtcctgctattcactgaacattttataatgaacatggaaacatgatttttttaaaatttttatttatttatgatagtcacacacagagagagagagagagagagaggcagagacacaggcagagggagaagcaggctcatgcaccgggagcccgaacgtgggattcgatccctggtctccagggtcgtgccctgagccaaaggcaggcgctaaaccgctgcaccacccagggttccctggaaacatgattattaatgtctgcatagtatcccttaaaagggatgtgcccatgtcctattgttacatatactggtgtttttttttctcctatttttcctcatcatagtgcctgtccttatacaaattattttcttagggcacaaagctgtgtcaaagatttaagctctttttaaggctcttggtaattattgggggtcacagggtttgtcagaactccttcagttgcaagtgacagaaaaccaatgcaaactggcttaagtaaggagggaacacatgctggtttatgttgctgaaaagaccagggaagaaggttgtcctcaggggctgatttctgaggcctctgccacccactagtccctctttctccaccctcacctctgccttcctcagaatcagcttcttcacaggtaggcgcctccacaaggcacaggtgtttctgccactctaggtgcccactggctgtattagtttcctagggctgccgaaacaaattacgacaaacccagtattccttcttaaaaacaaaaaacaaaacaaaacaaaacaaaaaaacccaaactttatttatttgagagagagagagagagaaaatgagcgggtgcggggagagggagagggagaagcaggcttctcgctgagcagggagctcaaagcagggctcgattccaagaccccaggatcacaacgtgggccgaaggcagacacttaactgactgagccacccaggcgccccagtagaaatctatttgttcacagttctggaggccagaagtctaaaatcaaagtgccagcaaggctgtgctccctccctctggaggttccaggggaaaaatctgttcctgcctcctcagcttcaggtgactgtcagcatttctcgccttgtggtcacctcatctgtttggctttcatgtcaccttctcctctgtgtgtggcacttagggcctgcctggatgatccaggataagcctctcctcttaaggtctacaactcaatcatatcgttggcatatgaggtaaccttcataggttctgagtgttagaagtgaatacatcttggggagggaggcatgtccctaccatccttacagctcagaatcccagagaaggggctgaggcaaaaatcccaggggagggttctaattggccagctcgagtcacatgcccatccctaagccaatccctggggccagagcagagaaggcctctgattggttaggcccagtacacccctaacctcgcaggtccgagagtggggccagccccacctaattatgtggactaagtgtatccctatgggagacacaaaggaggaggccgcagactgctcacaggcttgttttaccccaggggctgcagcacctcttgaagggggggagagggaggatggagagagggtgtcctgcctgcctgcagcaggttacattcctaggtggcttgtccctatcgtccagctgttagttttttcccaaatgaacgggggaggggggggagggagaaattaaaaaaaaaaaacaaaaacggcagtaggttcaagagtgctttaatggggagtgctcccgggccttgagtcagggaagtctcgcccaggcaaaccgcaggggggtctataaagagtttttggtgggaagatgggggcagggcggcattccaattagggcaagggttacaggtcttttgctatggtagggtagggaggttagatggtgttggctggaagatgggggtagggcggcattccagttaaggcaagggtcacggggcttttgctatggtagggtagggcggcaagacggccttattgggaggttgccggcctggggtcggccgttttgaggtcccagcccaacaccagcaacctgagctcagcctgcatgtgccctccctcctcaggagtgggagggaggcgggtttcatctttccagcaaacagtgcgggtggcaggtgaactatggaataagtgcagggaaaggagggggtcccaatgaaagctccagcagaggaggccccagcctcagggccacatggctcctggatctgacatctctggtcctctcagtcctgccccaggccagtgacccccagagagctgtccattgtcataggtagggaacgggggagtatgggatgaggtgtccttagtgccatgaacctcaccccagcaaaatttccctcagggatctgcagccagagtgcttgcttcacaattgtattttgaagaggggtaccctcgggtagtctggctttttaattcaagatgctgggacctccaacaaatgtagctccaggcaagacaaagactctgggcttctgagatgactgtaatgactcaggactggggagccccgccccctacctcggacttccacactggattttaactgccttggctgctcctgtcatcagaaccccagtgagaatatggacagaactggggtggatcagcccctaagatgccctctgctcctcttcccctggcaggcctttgcacacactcacactcacgaatgtgtacctagctcttcagtctctggccatgaccatcagccaaacaaaccctactgtatttacacatcttccccaccgcagggcctccaccaaaagcagtcagcctacactggctgtaaaagctgggccaagtcagcccgtgggggtctctgggcaatctggtattgggctctgagatacgtgctcggagtcagcatctattctattccttctggggctgcaggggctgcaaagctaaagacgacatttcccagactcccttgcatgcagggttttagttcacattaggttccgctgaatagatgcacctgtctgggatcgggaagggcagaagcgaaacagagccactccctgctcctttggctgtgtgctgatggcacttgggctttcttttagctgcattcccccctctagtcaccagccttgtgggagcccagatacaggtatggtggtgacagttgcttgtggccctgtgtcccattggtggctctggattcagcaccttccggatggcgataacacctccccagagggaccgtgtcagcgttgctctgagacgtttctggaggcctagcctagagctggtgcctatagcacttcccatgactcggtaaacacctgattccctgcactaattccctctctgcttaaaatccctttgctgcttctgtttcctgcactggaccctgattgaaacagacacaaatgtactttgtgccaacagtttggacttttagcatgaagccaatagatcatgaggggccctaggaccagggtagccttgaaggaccacacagaagtgaaatcaggagtacagtgtctgcagagaagggcccatccaaccgcctgccatgcacacacaaacacacacacacacactggaaggacgtgtgtactttctccctccccggtgctccagtgtttggggtcgttagccacacatagccttgtgttataggatgtcttgttgacatgttagttcatatatactgtggtatgcccccatccctgaccttggctgttcctgttcagtagccagcaggacagctgttgtctcagggaagggatgagtcagcataaagaaagaaataagtagtcatggcctgggttttgagtttacaaaaaatcacatccctcaaagggaaatggaaatgacttacgtgggtgacgggagtaggtgggatgacacagaacaagcttcctgcacttctcccctctatacacacagagttttctggaggaagacttggggggagagagagagggaaagtaagcagggcagagatagcttgggcctgagaaacaggaggcctgaggtcatatgtgacctttgagcttggctcacacagctccctgattggattgctgagttccaattccaaattcttccaatttcattggcttacctcatcatttttagccaggccccaagtcaaggccactgagcagcctgtgaggagatggcctgtggctctgctgaccaaccctggtctaagcagcagtggtcaggaagtgggccacatggatggcagtgtggggtgtcacgcataggaggcttagagggagctgccggtgagggcacagctgacacacctagtactggagatggccagtccttcaaggcccggcctaggggttctaggcttttgtagttcctttacctcactggttcataatggagccacagagttgtcacctctgggaaccaggagttttgccagatggagtggagtgttcatctgcttctgactggaccgggctgcagggaactgctttgttaagaatttcaggtatcccagcagcaaagtccatgcacctttccctcttgacaacctgggtctgtcacctgagtgcactgtgcctcagtttcctactttgtaaatatatacacttcttgggaggcttccaggacattcatcagcatacatgctatggagaagcccaaagcagaccctgtaaatataaaccctgtggggaatggtgaactcaggcctctgtttctctgtctctccccatactgggcccccagcccaggctgccctccatggccccctcagaaccaaggcagagaaaggaggagccttcttcacccatgggcaggcatggggaggggtggggcgcagccaggctaggggcagtgaggcgccgacagagcccttctccccatgatggatggcccgctggctggagctgcacttccaatttgctccccatttggacagccgctctacccacaattcaacttgtcatggccacaaatcactctgcgccatcagaccaaggaggcagggagtgggaggtgcattggttcccagaggagcccaggctggggataggggccatgatgtgggggtgctgaggctgtgaggtttggctgggacccctgtcctgggacctcttgtcttccacacctgcccactccagccatccccatagttccagatggcaggctccatatccactcctaagccccaccctcttcccagtcccccggaaaaaagtcccacataccctatgtttattgtcgtattcccccaaactgtccagctcaacagtcttgctccatttgtgctcagaaatccccagggccttctgctgcctttctgtgcctcagtgggactgatccactccatctccaggccttaccggaattagggctatcgatcattcattcattcattcactctgaaaacattgagcattcactatgtcacaatggtgagcaaaaggggcacaggagtggctcagtggttgagtgtctgccttcagctcaggttgtgatcccggggtcccaggatcgagtcctgcatcgggctccctggggcggggagcctgcttctccctctgcccatgtctctgcttttctctctgtgtttcatgagaaaataaataaaatcttcaaaaaaaaaaaaaaaaaaacgtgagcaaaactgtgagcccacagtccaggtggcagacagttagggaagtgtacaaacttcaaactgagaccacagctgagggaggaggaaagatcgtgggaccgttgagggcatgctgctggggagcccaccaggtctgcagtctctctccacctcattacttcaaagcactgcttaggctcacctcctctgggaagcctttcctgattgcccggccattaacgggcaccttgtgatgggtctctgaattaagacttctggtggtgttttttctttctgttaagcccccaagagttaacataagggtctgcctccccaagcatggtttggataccaccagcacctccctagggctcagctcagatgctcagatgcttcctccattcctgccatgtgtcttgggcctggagcacctcctttggcccccagcacatcctgggctcagagggcattgaagctgccccccaccccccaccccgtacctccaccaggtacctctggggcatccagctttactttaagacccaaacatccctcctccagttccactgctaccccctggcctccccctacctctgccctcagctaatgatgatgtagaggcagacagagcaggctttgatctacagcagctgcctccctccttgatggatttctgggcctcagatatcactttcatcagccccgttacagtgttccagtgttcccagattcatctcacggaaggagctggtgctgctgtgctcagaatgcactgggagggcgactctccctatgtccctgctgggccaggatctgggagcagctggtggttgaggaagtgatggcagggccggacaactggcaggccccagtgcccatccatcagtttgcctctctgcagaatgagtagagacatacacactttccctcttcagactgactggaggctggagaggggtgcaggctggcaagcgtcctctaagactggggtctgggaggcaggggctgcccatcacccatcacagtcctccagaacgtccccatgatgaaatcttacaaagaggaccagcccactttcagccacctcagcgtgtgaacacctgcttttaggcaaaaaccaaatggggaggacaactgtcctctgcggagaggaactcaccgtggggtcctcactgatgtgttttcctggtggatttcaacgagtattcttttgcctggcattgatttatcctcccaaccttttgggcactcgtggcttgtatagagggaggactccgcacatcagaggcaggtctgccgagctgatctcagcagagagccttcagcccactagatatgtgggagccggcaggagaaggggggaggccgcggtcacccctcgcaggccctactcacatgtctgccccccagggtgtgctgttctggtacccagagatctgggggtttaaacttggcaactattgcatgcttccaggaggagcagaacaaagccgcttccactcctgaggctcctctcccccctcctctcccttttggtgcgccctgggccctgcgttccatctctcctctctcctcttcctcttcccacaggcttttcccacttgcctctcactccccggcccctgcctggggccccaggggccccagtgtcatttgcacaggaggctccctgtctttggggtcctctgattggcctgaagggaggctccacacagatgatcaaagaattggaggataataggatgggtgtttatgggtggctagtaccaaagccctgaagctccctgctggctccctcagaagtgcccagcataggacccttattctggggagtggtgagtttgagccctaccatgggggtagagattactcacataaataaaaatttaaaaaataatttttttaataccaaagctgtggcagttcctgtgtggcagctcctccatgcctgccctctccgggcccactccctcctttgcccctgcaggtttcggcgtggttgtgagtccccacactgtctgcccctaggcatgcaccactcccgctgtttttccagagtgcccgtttgaggggccatctgctttctgccttgccttccactcctcctggcccgttttgtgtcctggtccttttctctctaatctttttccttttgtccctcctgaggctcattcctgctgggaagggctccccagggaaaccagagccaggctcaacaggggtgatggtggcctggtagggcctggagtcctaggcgtggtgaggcccatcaacaacttggaaggttctgaagttgagttctagttgattcatccaggggtgcacaggcccaagggagatgctccagattagtcaaacccagaaagcaggtttataaaatagatccctttcttctgtgtatctaacaaggggtcccatacccaatgggaatgacacttccagttatttgttgaggacgcccccttccagggccaccacctcagggtggggagaagaaatttggttccttgaggcatttgccataaaacataaatctcatcaaatgctctttaccaaaggggtttttgtggccaaataagttagagaaattctgcattttgtagactcccaatgtgttccctctatcgaagactctgaaatgctctgtggtaaagaatatcctgcttactatgtgtttggctcagtgttcccaaagctggaccaaggaaccaaaataccctttttccccccaaagactcatttgctgagcccaagtgttctagaggacacactttgggaaaccttgatcacaggctcagagtgtacagctctgtggagtagagaaatgagagcaggctttgggctaggcagatgaggctggagtccctcccagctctggttcttaggggcagctaggtttgggcgcgggggtaggagggaagtactcacaatctttcaagtctaaatttcttcattttctctcaaaagggaagaatccacggctctgaggattcaagatgataatcatatcttagtgaagactctcttggttgcaagaacaggattcgtgttaaacgaaaaaaaggaatgtattggaaagatgctgggtgtcttcagggcagaagtgtagcatgaaggccccaaaccaggagtgtggtaaccttggcagtgtccagaacccatccttcagctttcctctctacatatctgcttcctctgcagactatgtttttggctcccaggggggtggggccagctgtgctacccccaagtcccatgacagcctcagctcctcagctccgggcacttcttcctccctcagtctccatctggactggcagtagtgcccctcaggacaaattggagtttgtccccagaagagagtacctgattggctcaacatggtaaatgtctgctcctgtccaaccacctgctgccagggtgctgggggcatgtgccgactgggccactgtaccttagctcatctgggtcaggagcggttctcagcatatgtggtccaagggacacagactgagcagatgcccacaaggctgtctgctataacacataaagtgcctgaaagccgggtaagtacttggtaagtgtagctcatacgagtaagcgaagtctgtctctgagaaggaagtggcatttagcaacaaggactgttgtctgtcttgaggggctccactcccatcccagaaacttccatgtgcataaaatcacttggacacatgttacccacaaaggaaaaaaaaaaggtaattcagaccacatttggataaaaaattcagtccatcaaaagacatcagtaagagcaaaaaggcaagacactaagttgaagaagatatttgcaatgcaggtgcccaaggaaggactggaatccagaatatgtacagaacttctataaatcgataggaaaaagacagacagtaggattccaaattggcaaaagaccgaacaggcacttcataaaagaggaggcccaaatggccaataaacataggaagatgtgcttaacatcagtagtcaccagggaaatgcacgttgaagcataaaatgataccaccccaccggaatggctcaaatgcaaggagaaatgtcctcaatcttttgtgaggatgaagatcgagtggaactctgagacagcactggcgaaagcctgcattggtgtagccactttggaaaatcactcagcagtatcccttaaaccctaggacacaacaattctgcttgtagtagatggatacccttcggaaatgcacacaagtgtccacagaggtatgcgtaccacaatgttcatagcaaccctgtcctaaagctggaaacacctcaatgcccagcccccctccaccccgtaggaggcagacgggttgtaggttgtaggacaggcaggctggagtgctcctcagtggtgagcgtatataaaccacaacggcgcataacggtatgagggagcctcacagacagtgtcaagcagaaaaggccagacacaaacagctgtgtaattctatgcatgagaagttcaaaagcaagcaagaaggagctaagctgttagaagccaagatagtggaaccctctggggaagttagtgacgggaagaaggcatggggggggcagtttccgagggcttgtttatgttctatgttttgatctggtgtagattaaacagatgcaatttgtgagaatgcattgagccatcctcttgcagctggtcagtcttctgtattcatgtatccactaatagcatttaggaaaagccctggagagttgattttattttttattttttattttttttaaagattttatttatttattcatagacacagacagagggagaagcaggctccatgcagggagcccgatgtgggacttgatcctgggtctccaggatcacatcccaggctgcaggcagcaccaaaccgctgcgccactggggatgccccggagagttgattttaagtgcaggttcctatgactcgctggcagaaactctggttccttgggtctggggtgggacctgggagtctgcatttgaaccagctccccaggtgatcctggtgagggtttgtgtctgagcagcaggctttaacctggtcctggccagtgctggagagcgtcaagtggagctgggccgttcttggtggcctgcccagtcggcccgaggcgctagcggaagggctcagggtgctgcgcaggagatggggaggtgagaggaaccgactggtagagcctgtgcacccaagggaaccccggcttgctggagaactctcaatggaaaaggaagtgtggactcttggacaagagtttccagagcgtgagatgtgtgaggtgatgctcagagggccagtcattctcaggttaggtgtggacatcgggagggctccattcgatgtcacaattaagtgactctctggatctccgtttgttttgttcgacgtgaggatggacacccttgatagccttagaggtgggttctagcctgagttccaggtctggtcctgccctgcaatagctgtgtgaccttgggtcagtcacctgccctctctgggccttaggtttgtacccataagacaggatgggactctccgaccccaacctctctgttcacgcggccaaccttgggacagctctccctcagctgtgagctgggaccatccctcagacctctttagagggtgctgctgttgacagcacaggctatggatgctctgataggtccgagggtccgttacaggtctatttcctcctcacttcctgccccgtcagcagggctgggctctaatccctctgtccctagcagtgtcaggcagtgtcaggcatggcaaatctggaaagctctgaggcctctctgctctgacattctgggttctggtttcttcctttctaggaatactataaccacacgcaagtcccaggtgcaagggggtctgcagtgccagcccccctccggctggcctgtgataagactggactcttgggggataagaggaaccagagaggcgcccccacctctccctccggcccagagcccaggcaggcgggcaggtgggcaggtgggcagttgggtggttctggctgtccctctgctgagttcattaaagggtgaattattaactcctggccggggcagggcagcctggggccccgggcgccccttggagccgacaggggcaggcctgcgctaattgaaggcttaatgaattttcccagtggaggctgcagccggtgccttctctctgccatctggccatttgtcttctcctggtgggattaccctctgcctgtccaggatgccaactgctcctccgtctgggctgccgagcacggtgggctcccagcctggatctccaccctaggggctccttccttggctcctcagcccctcagccctttggctgggtgctatgttccaatcactcctcattcttccaccttcaggcttacttcaaattttgggcatttccacataggccctggagactcgccagctacacctgagtggtccgtcagaatgttccagaggtgggcagggctgaatactgtcagctggccttccagtggttccagaggagttggggtatgggtcttcacaccccaccactgtttgtgtgaacaaggcactcccttggcaggattcaagaactgagtgcctggtcccgggagatttgctcgctacagaggcaggtgggggagagaagggatgcccagaggacactccccagagatgggggggatacagaggggggatcttaggtcagggagctcctacaacgagccaggcatccctcatcggattctaagattcagcaacatcttttttttttttttttttttaagatttatttctttatttgagaaaaagagggagaatcctcaggcagatgccccgctgagtgtggagcctgccacagtgcttgattctaggacccagagatcatgacctgagctgaaatcaagagtcagacccttaaccaactgagccatccgggcgccccactcagcaacattgtgacatagctataaggtgccactgtacgcaagggaatttgggggcacagcgaggtagctcatttgattcatatcccgctggtggtacagggcgtctccagggctggcttctccatggcccccagagcttctcactttgactccgtgagatgagaacctggctctcccgctttgctaggacaagttacctaatctgtcagaacctcacaccccaaggcaggagtagagtgggccccagcccctgtcccagagccagagctggaactggcaagggcaagggaggactggggtagggttgcttgaggaactgaaacttatttggaattggggtagaatctggattcttgtcacttccaggttaggaacaaagcctcagaccagatttgggattggcgttctgaatgctgcttggttaaggactggggtcacggttgggactgggttgggatctgcctctgaggccaagactggagttgtggaagcctggggagggatgggaagtgggagtcgggactgggaactctgggcctgcctttgtgctgacccactgctgggcccggggctcatcatttccctttgcaccctttggcctcagcctccttcctggtctgcaaacaagggatcgtcactgtgtcgtgtgtccttgcagctgtcacagaacaacaccagccaccaccccatgagtggctcctgcgttaggctcgctgctagtgttctttgtacatcttctttaattatgacaagcaaaggagagaagagatggcaaatcgccatgacaggctacaggcccccgtgagctaggaaatacgtgagggttatgttcctgccaggctctgggtgtcttgctttctatagaccagccccttccagctatgccccaaataacagcttgtcctcacagattctggctacgcatctcgcctgttcccctgagccctgggcctgcctctgagcctccggaagggcctcggggaggactcccaaccatcaccacgacctccctgttccctggtttctcccggggtctcgagcccagggcgtctggctccggcccgagttgggaccctccaccacctccgttggagcagcttcccgcccagggcctgggcccctgcagtgagggaggagagctgggtgctctctctcccagcacccggcctgctaagaacacacacttgttgcttggagacgtgctgagctgtcagagccttaaagtcactctcgggggcaggagaccccggggctccatcgacagaaaccgtgagaggggcagggcctctccttcttgagtccaagacgggcggtcaccatgctcatccctagccccgccctgtacgaggctctggacctctctcccctctcctggcagggacaggaactggttcatgtgggagtggtcttcctcttcccttgtctggaagcccctgaatcatttccatcgacgaggtgtattttgacattgtcagagtagcagccctaagacaccactctcagggacctagcacactccccctgctccagcccagaggcctcgctgcgtccccagaacgtgccctcacccacctgttgcagggtcttggcactctcggctccatctgcttggaatgcttcactccacgcatctgttcctaggtcggctctcaggggacccaggggcagaagcgggcctccgtaaatgcaggcagccccagcagggcctgtagcttggtgaaaggataggtggccggggaggtggggctggggtcagtatgggggtcagtcgcagaactactccaacggcagcagcattgggcctctgcaaagccggcgctggctccttggcctaatgagcattcactgtgtgcccaggacgcagacattggtgccacatgctcccgttgccttggttttcatgtctacaaacacattgggtccctgcgcccctctggctctgattttctgagtcaagaccagctgggatcccacctgagaaactgatgcacagaataggagggtctaactgggggagagtggttcggtggaaggtttggggcccagaggcagtggggttgttaagggcagcatgaggtccacgcggtgggcaggtggggtcaggaacctatcctgtcttgctccactcctgtgtttgggactcttggggtgtctctccttattcctggaaaggagtggcctcaggccaggggagcccaggttgtgcccggagcagaggctagggggccgtggtctccttgtgaacttggtggaatttacactctgggaaggggtcgatggggaggggcatattcgagccctgctttccagggtgggttgggcctgggctgaccagccaggctgctgaggaggtgaccagcagcagggtcctttcaccagggcctgtccccacgggaagggccttgcctcatcccagcttcctggaggcaccagcctctggccatccttagtggggggaaggatcctgaggctcaaaggggttcagacaggggcaggggagatatgggggacaccgccgcctccctggccagcgggtgtgtcttgccccaccttgctgctggggtttgaacactttcatgtcacttttctgtccacctcccaccgtgaggccaagctgatgccagcacgactttgatacctcccctcccaaacttggaagttttcaaattgccagctgggagtcgtaaatcaaaaagggatttgggggagcacttgggtggctccgttgttaagcatccggcttcagcttagggcgtgatcttggggtcttgggaatgagccccacattgggcttcccatgggcagtgtgcttttccctctgttcctgcccctgctcgtgccctctctccctcaaataaagaaataaaacgtttaaaaaagattttttttctgttcttggggtgaagtagtgtggggacaaagcctgggtgccccatgttggcatttctaagacatttcaagactcctagggacaagggatgggagattgaggacatgattctacttgaggaggtggcaacttgtcagcaggactctggctcccagcctggacgggaggctttcgtggctggggccacagcctttcctcttagggcacggaaaagagggaggctcaggatggcccctcagcgctgcctatggacatcagggagcagacaccttcttgagggtgccctcctggctggagatgagcccaagtcgtggccctactcctctcctataaagccgatactggttaggtgccgggagcccactgaggcctgctgccaacagctctgacatggcggggggtaactgcccctggaaccccagagaccccttgaagccttctttttttttttttagattttatttattgagagagaaaaaaaaatgagagcatgagcaggagtgggggtgggcagaggcagagggagaagcagactccctgctgagagcctgacatggggctccatcccaagcctctgggatcatgacctgagccggaggcaaacactcaacctatcgagcacccaggtgcccttccttgaagccttcttgttaagtcttctgtctgcagccctagcctagtgtttgagcacctggcttgagtccctcttcatatagaatcctcttctccctctaagatagggtctgatggtccaactgcctcactccaggctgaaaggtactgccgtccagcctcctattcggagcctccaaacacagaagactatactgtgtggtgggtacagaccagagaggctctgggttcggactgcctgcacgtgagcccttgcgctgctcctcagagggtttatgagcctcagtttcttcacctgtaaaatgggtaggacaagagaaccaatctcccaggactgctgtaaggactccagggaataaggcaggtaaagctcttagggaagtgccaggtagagccaagtgcccagcacagtttagattttagattttaggtttcatttttagcagacctgaaaagaacaggatgcaaagtcaggcaaatctgtgttcaattcctggctctcacacttgctggctgtgtaacattggcccagccagttaagctcagtttgttcatttgtaaaatgaggtttaaataatgacctactggggcacctgggtggctcagtgattgagcgtttaccttcggctccgttcgggatcctgggatcctgggatcgagtcccacatcgggctccctgcatggagcctgcttctccctctgcctgtgtctctgcctctctccctgtgtctctcatgaatgagtaaatgaaatcttttaaaaaactatgatccacttacctccctaggttcctgtgagggctgaagggtccatctgcagcttggctctgggtttagcacatggctgaggctcattatcaattaacttttcctactcttcttcccgcctggcctgcatccccaccagactctgtacacagcctcacccagtcctcttctgctgccgtgccttgactcgagtagccatctggcccctgtgtcccaccacacttgttattcttgggctgccacaagtccaggctgcccctaccccgggggacagatgtcagtctcacgggctgtttgaaatcagttgagacaacaggtggcagagctctttgccaaccatagaaggttctgtacatgtgaagggttaaagcgctgcctgcaagtgacacagagagctgagagtggtcccaacagaaccctctagaagcaggacgtccttggcccaccacctcctcctgagccagcctggagtctgcttccagccagcgctcttgcttctccatcctaaatgccatttccccccatctaaatgccatttcccctctctgggcccgagccactgcctgctgtctggggcggctggaaatttctcaaatgtcgctttgatttatggctctagttaattcttgaggaggcccgtgagatgccctgagctctggagcctcaatgggataaatcatttaacaggtagttaaatattctttaaggtctgaggagcacaggcagggtatagactggggacggaggctgggggcaacttggcaagtttctgaatggaagaaaggaaagctctgcagccgcctcagagccatgaggacgatttgtcctaagccgtggctagaggtggcacctgggggccctttgtacccagagacccaggaggccggggacacctagggattggagggtgtggagacagcaggaggtgggcaggaggcagaggcagcctgctgggccccctgccagctgtgtggtcctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtacgaaggagggacagggtcagagaggctggaatcctgcctgaggcagcacagctggccacaggccaaatggaatccaggaggatgcaccagagggaagaagcctcgggtgtgggacggaggatcaggaggggacccggaagtcacaggtccaaagcatccattttaaagatgaggagacagggcctaagacgggaagaagtggacccgagggaaggatagtggcagagatggggatgaagcctcagggagaaggccagagggtgcatgtctgcccctcaacaactgtcctcccaaggggactgtttcctgtgaatgaaggctgtgttagagtctcagggggctatgaaaattgaagtggcagtggtccaggtaggaaggcagtgggagtgggaggcccctctgagagcctccccgccctccctggtcccccatgctgtaccctgagttcacacctccttcctggtccctgatcctgcatctgtctgatgcagccctggggtgcagggccaggccaaggtgaggcatcactctgtcccatgggagaacagattcctctagggctggggttcagctccatgggtgggaaggagcaggagaggcctgggctgacaccctgcctgaccgtggacccacagagacacaggtctgcttcagggcatcagggctgtttgggtgggggtggggggtgtccccaggagtgcctcctgcccctagctttctttctttttaatattgccatttaaaaaaaattatttatttattaatgaaacacagagagagagagagagagagagagagaaagagagagagagaatggcagagacacaagcagaaggagaagcaggctctacacagagagtccgacgcaggactcgatccagggactccaggatcatgccccaggctgaaggcaggcactcaactgctgagccacccaggcatcccaatattgccatttttaaaaaaagatttatttaggggcaggctgggtggctcaatggtttagcgctgccctcagcccagggcatgatcctggggatctgagattgagtcctgcattgggctccccgcagggagcctacttctccctttgcctgtgtctctgcctctctctctctcttaaaaaaaaaaaaagatttatttatttgagagagagggcgcatgtgagtaggaggagaggcagagaaggggagagagtatcctcagccgactcctctctgagtgtggagttggatgtggggcctgatcccaggatcctgagatcatgacctgagctgaaactgagatcgggtgcctcactgagtgagccacccaggtgcccctgcccccagcttcccaagcaggtcagaatgcacaggagcagctagagtgggcacggggccccgggccagtgtgcggtgagctgccctccctgccgggccctaccttgcttcctatcagaaagctccaggaaggtgatgcttgctgtggtgcatgaactggccccatggctgaccagggagttctggaaccttgggaggttctgcaggctcaggaggcagtccaagaagctgatgtcgtaggactgacttgttttagggacaaggccagtcccttctttcctgtgctccgaccaagacctcaggggaccctgaagctgccatggacaagtactgggttagggtcggggggatccctagggcatctgccacccacccctgcagctgtgtgtgtgagcgtatgtgtgtgtgtgtgatggggaaatgtcaccccacagtgcccgtgcccacgtctccagcccattgtggctgatgctcccaggttgactgcctgtggcccggctgggagtttcttgtgcctgtggttattttctctcccaggcgagcatctcctgtggcagagggaggtctcaaccgcagcattcccctccaagcccccgggttaacatggcacaggcctgggtcctggcagatgccactcaggtgaatatgccccatgtcagagcatggcagagtatgccatgtggtccgcagctgttgccagggctatagaggggaggggaggagcccagggtcccccgatgagcctggctgagtcacctctgggtgtaggcgaggggtgagggcgggagtgagaggaacaggtctttctgggtgtgcagtgacaggtagtcctggagcatcttggcaccctcatcttctgagtcatcccatcactctctcttacaaccatggaggatgaatgaataattcaccagtggttccaactttatgaagtatccacccttccctggcctccagagtaattaactctcatgcaggcagaggagcatcatcaacagcccattagcaccctgtccctagtacctccatcaaaccgctgtctgggtggggcttcctgggaatgagtggtgggtggtttgcccagggagcccagggtgagtgaggtcttggctctagctcctgggtcctcagtctggagcaaactgttgctcatggattttgcagagagctgggggttgcaggtaggctcttagaaggacttccaggggaagagtagagcatcttcagcctctgtctggtgggactttagatatttttctttttgcagctgggggcacagagacagggaaattgctggctcgtcatctcatagcttgtgggtggtcaaaaggggagctccggtccagtgctctttgtattaattaggctttctgtctaccctccgcctcaccttgagcccagcaatgtctccaatgggggtgtggagagatagtagagactcccctccaggaagggatgggtactagagggaaccaggtcatccttccctgggccactcaccccttggtgcttgggatgacctgcagagaggcagaaagcccctccagacatgggtccacttgctcagtgagtaccactcacctcccaggtgctgcgttggtaccaccctgtcctctggtgcacggagtgggcagatgggggctgggtaggctgggcagctcagaggcccagagcaagtggagggagcacaggggcctgggctgagggttcacacaggcctgaggtcattggctgtttgggggggatcctcctccccagctggagccaaagagatgggagagggggaggaagaaggcagagccttggaaggatagtatagggagtatccagcctcagacggactggcaccctctccagtcccctgacagcaccttgtaccctcgtgcccctgcttttgtctgagccacgccctctgaaagagagcactcagatggctccttcctctctgtgaatagatgtgcatctaaccacgcaggtccctcctccaggagtcctttcttgatccccccttcccccttcccagttcccacctcccacctgggggttaggccagatgtccctctcctgggctcctcatacgcccctcatgttgaaatggcttctgtgccttagtcatccaggcagccctgtcccagcacctagcacaggcaggctgagatcagaagctccaaaatcagctgctgagtcagcgggtgggctgccagccaggggacctcatctcactgcctggccctcactcccatttgctgcgtgaccttgcacaggcctctttgcctctctgggcttgggctgcactattgttttccataggtttttgaaatgcatttcacatccggacaccatacaatccccatatgttgatttataaaacctaaattgagaccaaattttgcaaactgatgtttcccttactacatgtgtcatactctttattttgtgttctcttcccccactcctgccccaaaggctggttgcaatccatgaagtggttctcccactcacaggtgccgatggccagttggaaaatactgcctaagatggtccccagcttctctgctgctcattgctcctgcactacccccttcaaagacttttccgacgtccccaacaaagacagcatcagggatgaggctcgaggaggccacagccaggtcctcagctctctgggggagatgttggctaggctgtgtctgacgcctcagtagggagtatgccaacctcttccaggctctctgagcagggtggggaacagaaccccagctcctagcccctgctccaggcttctgcctgtttgggaacctgcagaagaggcctctggaaaaccccagcagagatgcttcctgccctggcccaacctagagatctccccagtgtcctacgctctgttcttacagggaccccagcattcaccttctggacccctccaacagggaaaggaggtgcgattagaaagggcactaggacgatgggcatcaatcaggtatctgtacaaaccaggatgagtggtgaccctgtgggggcccacccagccctcctccccttccaaggctcagaagcaggcgcgtggctctctcttccttacctgggcctcaggaggcatgcagacgcctctcttcaatctctgcctcgctgtggggaccatgctgctctcagcaatgtaatcaaccccctgagcagaccctgctgaccactgtcctcccgcaggtaaaccacgaacggttgaggggaggccgtgtgacccagtcctgaccagtgagatgtgaggggagggtttctcctgataggctgccgggggcagaggacttgtggcccccaatctgcccttggccgtctgggtggtgccgtgggagagcttcagtagtcgtggctgatcctgaggaggacggagtgggacaatgaagggagcctgggtcttggtgacaggactcctgagttggctgagtgacactgggccactccaaataaatttgtaccacaaagataagtgtggtggaaccctgcagtgttacttgcgcgacgtccattacccctccttccactcccagtgtgtgggttagtgtaggagtcctcactacacaccacacaccccatgggtcccgatccaggcttggcccatcagcattttcttcctcctgattatcaattggttcaggctgagcctgtgacccagtagaacccgtgaagcttcgttaagggcgttctgctgggacatgggggaaaaagaagttctctcctccactgggacttctaaggtctaaagctgttggccaccattgtgccaccttgggaagaacctggggacataatggggagaaagtctgagttgtggtgaggatgcatgggtgtcccacaatcaatcctacccctggatggcccggggccacctgcctgaggatgtgtaacaatgggctcaggggtgcggggtggggtagagagagtcctgaggtggtgtgtttgccaattcccggagtgtacacactcctaccttggctgactcaagctaccgactgcttgtcattgaacagagttgggaagaagtacacacggttggcccttccaagtctatgaggaccagctccagcacactgctggggttaagcccctctggctgggctttgtgtcactgataactagaatgatctgacctccatacccagtcccactatgctgggagggaactctttctcagttgggtgtgggctcctatcaagactgagcaagtatgtggtgttccccattcgctacgccatgggggtagctgtggtttcgttgggctgtgctctgctgttttgggctctagaggaggctgtggacacctcgaagctcctctgtggcctgacctggggctctgtctcccctccccaacccccagatactagctcattttggagcctgggctctgacccaaagcaggaaaagctgggccttcaagccactctgctctctgcctccactacctgggacctggctgcctgggttttgttttggttttgcggtggggaggtgacaaggtaggaggcaagaaccggcagaaagaatgcagagtaatatcttaagcagttgtcctgccgcagggaacagaaacagcaccttcctccctgggctgccgggaggattaaattacatcagactgggggctccgtctaagcctctgccttctgcccaggccctggggtcgagccctgcttcgggctccctgctcagccgggagcctgcttctccctctgcttgtcgctccacctgcttgtgttctgtcaagtaaataaaatcctttaaaaaataataaatcacatcaggcctcagagtcctcaggaaccaacttcccatgcgtggtgctgcctttctgccagctattttcataactgtgctgccgtcctgtccacacatccctgtccatgcacccacacacacccctgcctgcctcccagaaaaaaacctaccctgctcttcccgaagcttccttatcttgataaatggcagcttcatccttgcagccagacccagtccttggagctattccctcatcccacctagtccaccagctaggcggcctgctccacctcaagatgtcagccaggtctgaccacttctcaccgcctcactgcttccgctctggttcggctgtttcttgtctctcctggaggagtacagcagcctggcgtcactgccactgcctgtgccccatcctcaacccagcagccagagtgatcttattaaaacctgggccagaccattccactcctctgctctgacccccacagtggctcttgtccccactccaagtcaaagccacagggccctaaggatctgcctcgcctcacccctcaaccacaccaacacactctgcccctgggcctctgagggtctgctcctcagaatgtctggaacattcttcttcccagatttccccatggcttggtgccatcagggcaccttcttggggaggtgccccctgcattgctgatcatgccatctctgcctccacctcactctactttgcctctcccagcactgactctcagtgtttgacaaattgtctgctcagaggcttttctcctctacccatccaggagggcaaggccaccaagtcactcacctggctgagacgacatgttcttgactggcccagaaaggtctggcctggggccttgtcgtcttccttgctctattcccagggcctggatcagagcctggcataagcgaggagtacagtacctatacatttgactggcctcagtagtcttagaatacatttcctgcagttgctccaaagtgagttggagctgctcagaggggagtgtgcttttccctctccctctgccagttgctccccctgcttgggctctctgtgtcaaataaaatctttaaaaaaaaaaaagaaaaagaaaaagagaaaccagatgttggccctgttgggcccaaatctctgcaagcaacagtgccaagaggccgggtaggggaggctcccatttgagtctacactctctagctagcggcaggcctcaccacccctattgctcctcaggacactgggctctctgctcctcttgtgcacataccctgcttccctcagtgaggtctcatatttggcttctttttggcacttgggtttgtgatccttggtccaatgaatgaagttccagctccttccaagtgtatgatgtcttctgtcaggctccttcatacaactccagctttatccctggcttctcctggcttgctccttggactccaataataaggaaccacttatagcttcctacaaccacactgatgttatatttctctgtgcctttgccacctcccctttttagctgagtcccattcaccttttattcttctactcatccccccctcttttattttttgtaagatttttacttatttgagagagcgggaacaagaaagaaaacacaagcggggggttggaggtgaggagtggggaagagggagaaccaggctccctgctgagtagggagcccaaccgggggcttgatcccaagacctgggtattgtgacctgagctaaaggcagacacttgactcagctgcccaggtgcccctctactcaccttttaaagctcagccatagtggttgccggggcggggggtgagggggaggtagggaaatagggactacaaagggacatgaaggaactttctaggggtgatgaaagtgttccatatcttggttggggtgatggttacacacatatgtacatttaccaaaaaaaaattgttttgaaagaatttatttatttatttatttatttattgattgattgcagacagagagaggcagagacataggcagagggaaaagcaggctccctgtggggagcccaatgtggaacttgatcccaggaccccaggagatcatgacctgaactgaaggcagacactcaattactgagccaccaaggtgcccaatccatccttttattatccccatttttatgggtgaggaaattgaggcaccgggtagataagcaccttacccagggctgagcaggaggtgggtgcagactccggtactctgactccacctggagcacgtggcctctctactggatctgatcaatggcacctgctatttgtattatgtagctctttctccctcgcatgatcccctggtgccccttgtctttaaccatgtcccagaatcatctccagtctttaaggtcacggtcacagttaacaggacgcttgcaaaagcaagattttctcattccccacagagtttctggatggagaacaggctgggcctcatcaccaggcaaacacccgcgttgtgttgacaggagccaggcggattaacaacgcagacggttcagctcaattcacaaacatttagccaacacccatgatgtgccaggcagtagtctggcaccaaggagcagggcagagctaggaagatggagaaaaaggtgcctcagctgggagatgcagaggaggatctaaaggggcctgagtgagagagctgtggcaggccctgccccacaccctagcggcccagtttcttggtttaactcccatctggcctaggctttggaggtttggaggtgacattcgtcattcttttgggccacccagaccctaagaagttggggggagtcctactccagacgtccctgtctcccactaaggaatcccaatgcttagtttcccagactccctcacagccagggcataggcctatgacccacatcctaccaagcagaagctatgaccccagaaagcaaatggttatggagagggtggctgccgacacccctgatcccagggtctgtggtggcagaggttagtgctgtatcctcagcgatggtgcgcgagatgggatgcctgtgttggctgttctacggtgagatgttggacgatactatattccttattggacagctgccaaacctgctcttgggccctcccagggtccctggcttacggcacatcctctggtaacttggtttctgcttaaactacttggagctgcttgtggttggtgactaagaggctgggctcatgtgttcagtcctcacggccctcatcacccgaccgccccacacacagcctctgctcacagcccagcagggagctggagatctcaccaccttgctcctcactcctgagcccttgggactgaggaagaagacagtggaaggggtgtgtggacatggtgggtgggttcactcaccctctatccccacaccctgctgtgctttcccttctgcactggaaggctgggaagctacaggctacacttcccaggtgcccttgggtcctgccatccagtgcactcacaggaggctttgactcaggagccgtgttttgaggagagggaggaagggcatgagtgtccactttactagagttgatgtcagggtcagtcatttgagggtggtttcctgctctggcactttctggaggcagcagctcacttgggtagcctcgttctggggtgtggtgttggcagctgtccattgctaggagttgtctattcggatcttctggtgcctttgtgagctatctgtgcccccttaataaattatttttgctggaataagaatcgtgggagtctgccatctgcagctaagagcccagtccaccctacccaatggagtccagcccttccttggtcctccctttgctccagggggtccccacagctgccacagctccatcagctcacccctccagtgggaacttcctcatggctcctgccaggggtaagccgtctccccagccatctccccaaccttctaaagaccagagccatggaagcctagggtcctcacctatgccagggcctggggctcttcccaccaccttggcccggagtccagagcactcgacctgcactcaccactccccgtgtcgcctgtctggagagagcagtctcctccttagctagtttaagcagaaaggaatatattaccaagagttcatttacagaattgtcagaagaacttgtgggagggtcctacttaccaaggaagaaaacaggccgaaaaaaaattacttggggcagtggggctggtggtcaatgtgctcctgggagtggccacatccccctgcttgcccccagtaccagccccgtctccgccctgacaccccacagtgtggctcaggcttactcaaaagccctccaggtggccctccagtgcagtggaggtctgtctgtggagctcctgccttagcacatgctgtctatgggagtgaccaaatctattgtgggtgctttacctgtttgtgagcttttaatgaatacaaaatcaggttcctagatggttctcttgactgatttttcctgcaggcgttatggagggccaatatagagaccatgtagagagcataagttctgagtctctgctagtgtgtgtgtgtgtgtgtgtgtgtgtgtgtgtgagagagagagagagagagagagagagtatgtgtgtgtgtgtgtgtgttgtggggcagtgtgtgtagtgtaacctggttacacccccttccccagcccatccgggcccaaaggaacacattctggaatcaacataaaaaataacagggataatagggttgaacagacccatttctcccacacttcagaaactgacatggaaacactaaaatctggacgaaactctggagcaataaacagatttcaaagtagtttgaaaaataaatagtacacaggactctacttgctttgtactctgatatattctgcttgaattttttcttttattctcttcttttttattttggtaatactggtcatagcccatgaaattggtctcactgctcgccagtgggtctccatcttactgtttgaagttcaccgtcttagagcatctccctccacctcgggttttataaaggcaagcaggagagaccagctgccttgtgtgcttggtggggaaagggggtcagagagaacagactccagcctttggaggatgaggtgatgagacagggcatgggctcctgggaggacacaggggctcttacaaagccatcaacaaaggagggcggatggcccagggatgcctctggggaaagaggagactggtatccagctgctagcccagaggccacagctttgtggtcctagaagtgtggaggatttcctaaggcagggaggaagaacttcccttccttcctccctccatacctccctccctccccttcatccatcctctctgccttccttactcccctccttcctcctcccatctctccatctctaacctcctttcttcctccaaagcctggctgagctggcttcctgtctggaccctgctcctccctggctcccagtctgtggctgagcccccttcttgctccaggtcttggggtgctggtcctcactgtccctgtgagctctgagagttcctggggtggctgatggctggagccctgggccaggggccagaaagggcctcagaggcctgtccaacggtggctgggtgatggggggatgggggtggggtgggaatctctagatgttggggtttaatgctttctgccgcacagcccatcctaagcatggaatattcattatatgataccaacatttagcttcagcaatggaaatgtcaactttaattatgttcaaggagtcttgatggctctgggaataaatcaatataaataatgttttcataaactctgaatcatgctcctaatagcattatatctataattttaatattcaaaacaatttttctttgcatcttcgcaattaattgatgccaagtgctcatttttctgttttctattgctgtcacctcagagccagaggctggagtgggggggggtgacacaggggcacaggggctgtgtccccggaacctgagaacattcctaattctactgcccaaagggccaggctccgtacgacgtctcttccccagaaaaccacccccatttctccccacccattagtttactcacccttctagcccagtgtctccaagaagcctgttttggccaccacgcctggcagggatgggtccctcttttacactagcgcgacattcccattcacggctccccaggtagacagtggggacagcaggacagcagtgagagctcaggacttgtccacggtgcgccaccagctgtgtgactctggacaggtgacaggtgacagtgccaaggggtcatctacgaggtagggttcctatttgcaggtcacagagaatgacgctggtggatatgagcagaaatggaatttattaaagacaccaggaagctcaaactctgcaagggccaaacagttctgcctggaggcaatccaccaggagcagtgtgtgaaatttggatgcagagctggtccagaggacaccactgacacgctgaggtcctggcccttgcagtttgcacagcagatagaaaggcctggatgctgggcagatgctgaaagctcttggaagaatagctggcgttggaaactggctgtggccgggccaccactgttgcccggatggagaactttcccatctgcagcctcctgcttaaacacgctggggcctggggctctgtgcagccaggctgcagaggagtatggaaaaatgagtatctactggttggcatttctgctaaagtgaggcaacctttctgcttatcctacgaggggaccccaggcataaggaggaggctcagatgatgggcagattggacaaacaatgctaccctggccacaggcctccctctgcctggtggttgaagcccttttgcagcagcattggggccagcattttctcagtagggaaccccacaaatgcagctcccacggcctcctctccaatctgatttctgccccaagcctctggttcggattcgctgtcccaggttgtcgactcatctacaggaagaatgcactgatgggcaaatgggagactgcattcctcatgatggttattgttctcatgtaaggaaagaattggccttcgggtttttagaacctgattgctcatgaggttacagcctatgaaccagtatcccaaacctgtcccttccaagccaccagccatttaaggtccctttttctaaggctggtaacctagccccaggtcctggtgacggcatggggaatatctggaccatggctggccctgtccatgaccctgacctagcagcacctttccattcccacaagcataggacggtgccctccatcagtcaccatgcatttgagagcagaaacgaaaactacagcctctgtgaaatcactcacaccaaggctttaaaaagatcaagcccgtttaaggatatattggaatatcaccttcactttcaaaaatgaaatttgtctgggtgggactctctgggagtttccagaccctgtccctcttcagtgatagtgggctgaacgctgggcacctaggggttctgcactgtgggagggacagacgaatggctggagagctaccctccaagtccaagacagccagggagggagggttaggagcaaaggggtctgtgctgtggagaatatgtgagcacaagattattctttgtctgggactcctgggggtctaaccagaggtgagtggatgcgtgggataactttctggggtccctttctggacattttttctaaagatgcccaaagagtacagatcaggtaaaaagccacaggagagcaggtgacgggactgtcatccccatgtgcatcattctaagggatctgccaaagacaccaaattatattcccttcatgcatgaagacaaagaagggacatctgagagctcttcttttaaaccgtgctcctcctaacaaagaaagaatgcaagcatttgtactggagagccgtccacttgattactacacccaggacaaccaattcatattatccctgagcaagatcctcggagattaactcgacgtctcataggccattcatctccctcgtccaggggttgggcaagcatgtttgctcctggagaacgtgatctcccaactttacctgagaagtttcttcccaacagcagcatcgtttaagagtcacctcctctgcctctacccattccttctcttctccctcctacctgtccagattttccattataagcagccgcaaaggaggagggaggtcccaaacagacttcctgagggtgtgggagcctcaccccagtgagaaggggcaacgagacagcatggcagcctggcatgtaccctgcagcttgagcagagggaaggcagacagggaggaagcaagtggtaacgggtcacagtgggagggacagagaaccaggggatggactccaggctgtggccagcatcaggtctgcagggtttggggacccaagggggtcgcagaactgccagtttcttttttttctggcgtaggcttgagagagaagccatgggcatagggtaggagtgggaggaagccaggaagggctggccaggtgggtggtacataattgagatcctgaagggaaggttctggccctcccccctccctggcctaccctaactcctgggcaaaagcaaaagtgggggacttccgggggggccctgtcagggatagaactcctcaccccatcaggtccggcttgtgagacctcagagaccgtccaaaaggagaagcctgggtagggggtagctgagggcctgatgcatggcccagagcagtgggcaggtgctccaaagagaccaacgtcatgccctcctgccagcatgagtgctggccccgggaagaggtgcctggctgcctggagcatctgggtgagagccagctctctgagaggtggccccatagctgcacctgcggggtagctcaaaatgggttgttggcaggctgtctgagcctcctggggggtgccagggccggtcacaagccgactggagagaggtttctgggggaactgtgtgcagaatggggggattgtgggagtgctgggcaggccagtggcaattctgtgctgtttgtcatctcaagcccttatcaggcactcccttcctctgcggagggcatcaaaaactgtctgcaggggtgaggtggcaggaggaaggagggtcccagaatgccgcccctgcccaccccccccccacctcatttttccttttcctctccaaccactccactggctttaaagcctgcaaaggagtgctcctctcctccacccctccagcccagagatgccaaggttccgaggcaaatgtgctttcctaggaggggcctctggagccctgtggtcctcctgtgaagacctgggggcttcgaggcccaggatctgcgctaattctgtgccagcccacagctgggcagaccccggagaaggaagctgtgctgcagagtgtagccagctcagagcagagcgcaggcctgtggggccttctcctcggttcctttttaagggctgggcccgaaggggagcctcgcttttggctcttctctctggtctccgcttcccacctcccacctgacaccaagcccggattccaccttttttctcccttttctctcccacatcccagctggtcagaaacagtatgtcccaagggagctctggcccttagcaatgtaaaaaaacgggtctgttcttagaaatacagtggtcatttggccagccctggggatcagttctgtcctggtaagccaccttcccagggatggccagaaagtggtgcttcctctcctgccagctccctcccagagtcatggctccatctgcttgggctcaaggcattgctggggctgaggtcctgaggcagggagtgacctaccacaagtccctcctgccctgaaggcctgattctcctcatctgtaaaatgagtggggagtggaccccatcatctcggtggttccttctagctaagaaatctctctgtgatgatgctggggattggatagcctcagtggcctgattgataaaaggtggagactaataaaaccattgagatgtgaagtgttgagtgtgaagagtactccctctgtcttttctggaacgaacatggttagcattaaaggaaggagggccctggccagggcatggggcagagtccagccggcacccagggctccccatgcccctcgcccccggctgcccaccctttggggttttgggaggaagccataggaggctctatgtctgggtgctggtccacaggaaaggcttacgcagacactcagagactatcttctgttgaatcatgaggaccggcagcagctatgacaaccagccatggccctgcttgccagggagcagactcagagtccttcttgtgtgacaggaacagggggcctcccaggggctgcctgtgcagaagggttaagccctggtggaagggcctggtcaggcttgggtgagggagagcaagccaccacggagcacacagcagtgggatctgcagaagaggcaagtcgctgggggacataaggagccccaaagccaggtagccacgtctccacagtacaacaagcgatttcttggaatacttgtggagagaaagagggcattgatgagtgcaataggtgcccccaccttagagtctagaagtgaacagctggggtcccggccaaagtccaggcagagggcagttctagactaggaagtccatggggggaaggggaacttccacacacattagtcaccatgctttgtactatgtgactccactgacagggccaaggcagccccctctcccctggggtggtgacccagtttgaggagcagcagagatggagatgcagtccgggagcctggtagggccatgcctgtgtccacgttcccagacctgctgtgtccccattgaccccctttctcatttctggaggaaagggagccccctttccaacagctgtaagattcttagaacatgggagcagaactgaaaagattcttagaatgcagggaacagaactggaaaggcccttaggatgaagggaactgcaggcaccactgcctggggtacccggggcagagtccctccctctgggcttgcctgctgtgagcccggttgcaggacaaggctggccaaaagcggaggtgtgagttcacaatggaacaataatagttccattcagatgttaacctcccagtgttgggtatcatttctgcatcatcctaccaggtctttcatcagcccagggcagcagccaagatagattatttatctccactttacagctgaggaagtgggcttgaacaggttacggaccttcaagtcccagaagctccaaaagtgggatggccaccagggggctgttggccgacacacaggggacagtcaactctccctctgtcttcactcacttttctcaagaccttccacaggtctgactccctgcacacgcagaaggggagcatttcagagaggagctgatcatagcccctggctgtgccacccctcttctgcgcttcctgtgtcctgaaggaactgcctcccagcagctaagccacccaaggggtccccagaacactgccggccccgggccgcccagcagcgggggcctggtgtgtgtggctggggcaccaccaccatcacagatggagcccctcggctcgttgtggcgctctttcatctgtactcagtactgtcaacccgttttctgcacagaatgaagataaatggctttgctctggaaaactgcatttagcatctcattctttttgtggggcagggaagtttccattgacaaagcattcgtattgcagatggcttgccatatgccacattccctctcgctatcaccttataagcagattctggcaggttccaggagtaaaagcttaattaacgagtggtgtgtacaattatgtacttaattatctactgctttcccttctttgttgtttcttggtttgcaaaagtttggtaacaattagaggcaactgttccctaatgcaatttctctctgcttctctctctctctctctctctctctctctctctctctcaattttgccctttggagactgccagtgggatgagaggggggcttcctgcttggacaggcaagctcaacgtggccgcgtcccagacttactgaccaagcttcctggggggcggcccaggcacaggagtttctaagaagggtctctaggatgctgatctgcagtccaggctggaaatccagacctgggcctccctgctgctggctggatgggcagtcaggacctgtcttggtctttctttgtctcaccctattggtccatcctggggagagtgagtgaggctggatcagggtagcaaggagaatgggaggtgcttacagtgggagggtggatggggggcaagagacacacacttctgtctcagggtaaggacaggggcaactttaaggagcagagcacaaaaagtaagaagacttggaatggaagccaaaaggcagcaatgtggagggaatctgctaggctgaaggcagatttgggggttagaaaggagtgattggactcccctggatgtgaacctgcttgcatcccatgtggcccaagggccaggaagcccaggctctcacacaggtcatctatggtaggcatcagggcagcggtgtcctgttttagcaaacttcccttagagttcaaactcacttatcaacacgtggtgacagaaggccacagagccgacagcagaggagtctgaagcattagggaggtagcccatgtggcttttcagagggccaagggccggccctgggctcctcagccgtaagatctccagtgcatcctcctccccaagcccacagatgttggttgaagctgggtgcagtctgaggaggcaggagggggttggtgtgggagaaagggagaaggtgcatgagcagaagaattgcagaaccagggaatcaggacttctctttctccgagtcaagggagaaacatgatggacatttccccaaaatgaagatagacagaggccgtgccggcacctcaaccaggaatcattggatatgccacttctctgcacgtccgtttcctggtctgcaatgaacagcaggggcaggaagagttcttggggctctgctaggtccctcacacgattctgagttctacagacacccccatctcctatttcttagagaagagtctgctgggctccagagggcggtgtgctggcagaaaaaatggtagtggccaggccgggcctctgacctcatggtgtcctggaggcctagaataattccctgcatgtgttaggtgctcagttcatgaaattttgacagacatgccagttgcagctgctccaggctcatgattccttcaaaagatgaccgtcttaccccagagggagagccagagttctctgtaccatgcctggtcccagcctatgggcagccgatcgaggtcggccagcttgagataatagcctgaagaggagagatgacatagggtttgatggattcggcttctcagaaggttgacctggaagcctgaggggttgagcaatgggagtcaaaactgaaaaggatcattagaaggaagaggtagaggtggggtaatggacagctgacacaagggggagatgatgagggagcgggagccgggtgtcagcagtggtcctgcggtgaggggagacagcgtgccctgggctggccgactgggggtgaccaaagaactcttcaaatgcatggctagggagcctgaggaaaaatcacagtggggttgtgaacaggaaggagggctcttccgctgatcccacctcagggccagggaccaggccccaaggccttctcggtgcctttcagccacagataaacctgcatacatcactgtatcccacaagtcccatctagccctctcccttaccccatcacactcctccccagggtggggaagctgccacatggctgccggccaccttcatggatcagcactggtggtacagggcagctcttctcccgagcctgcacccctggccgcagctcagggccacatcaggtcccagagtacccagccctcccgcatctgtcccaagtcattcctcagaagaacttcaagaagaccctgactatttgctgcccatgtatgccgtgggcacctcagatgcggtggggatgcggctagggaggtcagaatgatgttcatcacccctgctgagagggatggtccatgacactctggggactgctggaaaaggtttggaactctgtcctccttgcagaggcggagctcaacttgcgtcactcatggggtcaggctggggcttggggactgtgtgctcagctggccttggggtgagtgatcagtgctcttaaacctggtgtcactgaggatgaagagcaggggaggaagccccatgtaactactcactcttgtgggtgattgtcatttctacccctccaccagaagttcactcctttagccatcacccccaccctcaccccaggcagattcaccttgtcatgtgtaatccctccccaggtgtgcacgtagcacctccgggtggggaatggtttccacctgagctcaccagcccctcccaccaccctaccttacaagctggtccccagcagccccagtctgagctttgttgccatggcgacatcagggtcgctgggaagaaagaagggcccacagggagaggggggcagccctctgaacatcaacgaaagtgcgaaagtgcgtgttctggcctctccggctttgtggctgatactccatccaggccactcttgggccagaggacagctccacgaggcatcgcgtgaagccctgccacctccccaggcaggatcggctcttgtccagctgatccaccacgtgacttcccacctggtcactgcttgtctgctaccccgtgctcagttcaaggtctgggcccgtctccctggccagagtggatgcactctttccagcctcttctgatgctcctgcccctgctggggctctctgctgaggcttctggacagaccccaccttttgtgaagcccgtccatgaggcccacacttggcatcccaccgctcctctcagctcaagcatcatcttcccacgtgctcttccctgaacccaccggcctctgtgtggctacagaacactctgctccccactgagaaatcctaccacattctctcatttttaattgtttacaggtttgtcctccgcagaagtcttagtactggtcacctctgtgctgacattgttcatgtccaaaaagggcttgtcttgcgggtgtggggtggtgttggtgagtcagggctggggcacatgggtccaggtggggcagccagtgggatgaagaatgggatggctggctttcctgccgccttgctgatgagaggcccttgggctcttgagcagttttacccactaagaacttgagtgttcagagaaaataaacacctggatcttgtggcttcaacacgtgccatgttccatgtggttggatcaggttatcctgaggacgtttcacatggagaagggacaaggggaccatgtgttacaatgtgcccaatggacgccagtgtgtggaggaagcccggctcgttctacaaggccagggatggaggccactaggaagcagagggtgatcagatgcgtccggcttcagacctggctctcaatcagagctgcgtgcaggtgatggtgcagggctctaatggagaggaaatgcaggctagacagactcagatttctttctgtcccctccccccacttgggggccaggtggggcctctgtgggtgattctgactacatgattcttcatggaatttactcaaaacatgatgaatgtgtccccagtgttcttaaagcttagaatatctgagccaaagaggactctgggaaagttctagaacagaacccagaggaaaccaaagcttggatgcagcatgtaactgctcacccactcacagcagagctggaactgggccctgggccttgcctttttcccactccactaagacgagaacatgcatttcctgacaagcaatctgccaatatcttgtcgggttgtgtgcatgaatgttccaggatgccagaattaatgtaatgtctcattacgttactcttatcaccaaggagtggctcacagcatcccactcagggccagctgattcccccttgagtggaaagacgatggtgttgaggcaaggaccatgtgggcaggtgggaaaaaaaggagagaggaaacatttcaggggaccaaagacaagttaaagatgaggaagtagctaccttttgcgccccctcctcctccctacccatcagctagaatgttgcctttggttaaatgcctgtttggggtatgtgcaaaaatcaagaactctgccaggacgattccaaagtctgccacatggaggccaggagggaatcctggcagttaggagggaactgttatggagctgctttgtgaaccatgaagtgagacaagtgtcccttgtctggacacccaaagggcccactttgtgagcctgcagctacttactggccaggtgccagcgagaagactaccctctcaaggccatgcttggctagcttcacttcacagggccttgggtggtggcaacaaggaatcataacttacattcagtccttcatcatttttttttaaacaggttttaaaggactttcttatattattttaagcctccacttaagtatggataaagaagagcaaggagcaaaaaagtcttccctaggcaaatgcagacatgtgttccttcagttctggaatggggtagaaagactcctaggtcaatctgtatctcagtaccacatggtgactcctttccccttgggggaccacagatttgctcactttcatccctccaaatagctgtttctcgcttcccatcaagatctccatcccaactccagagaggctcctctgtgcccgggctcgcactccaactcactgtcactctccccagcacccccatcaggcctgcccctggagtcctggcacttgagaagcttcagtcagctatgccctctggcccccagaatgagcagtgagcatgttcagcagaaatgctcctcggctagcagagatcaatacgtcgatagaaacgtcaagctgaacataaacagagggaggctgagagaagcaggggcagggggctaagtaggttctggaaggaaaagagccagacagccttgtctagggaacagttccattcagttaagcacctcatctgcattgtcaatgaaaagaaaaagactcatttattcaggccccactaattaggaacccaccatgacacccctccggcctagaccaaagcccatttgtatcctaggtccaatgagaagggttttcaggagggacaacctgctgctgagctcaatccctgcaggcaggctttgcagctgggccttgcaggggcatcctgcaccatttctagccaggtctttcttagggatgtcttagtgtctcatgtccctcaccagattgtaagctccatgaggacagcaatcgggaccggggggccccctgagccaagcatgctctgtgccacaagtacccagaaaacacctgaggacctgccttggctagagcaactgggccaggcagcagtctggcacagtctgtccttttccttgggagagtttggaaaaatacacccaaaccaatgagaaatggtttaggacagggcacctctgcggaggtgcgactaagtgggtctgggtgggttctccatcatgagtccttgatcatgtttttgaaaaggaagtaggaagaagctagcaggctgggttaaacatggcagagcttagccaaagagaccaccaggtttttttttttttaaatccctctggaggtccttgcagtgctcagattccttgtgtaaattaaaacttgatttctttgtactgttatgtagctcgtgtcaatgcactcatggaatggaagccttgtgggagacaggggtgttatggagtgagagagaagaaagaggagcacttttggagactagtagggtagggctggatgtttaagagtgcagcaggaagggactggggtggctggagagcaaggacaagttattgctcaagaccctggcagtggcagccgtatccctgaaaagtcacttttgagattctgcactctgggtgacaaagaattgtcctcttgaacatcaacagattcaagggttcgctgggctaaaggggactagtcatgtaggagaatctggagttcttgaagtggttcagaaaaattatcccactggagagagatttggggcagctaatgccaagcctggtagtcagacggtcttcaaggattcagggatgggcttccgcccagctgctgggctgagcagcctcaagcagagacccttgtggaggatgctgggtgatggtgcagacaccagttctcgaaagtgagtgatcaggacagtttgagctcgaggtggataagctgggtggagtccagtgctctgagtggatggcccccgccttcccctgtgggatcatgggaggatggatgagtgaaaagaaaagatgctggtggggaatggggtcattgtagggggatattctggatcagtgaccctcagattctccaccttggcccgatatggagttgctttgctttccctaattttaggcttgccttgggtgggaaggtatatgagaatgttttggaccctggtgtggtggggacatggtggcaccaatgggcctggggataggaccagaaatggcctcgagagtgatgcctgatggcaacctctttgctcagccggcaatagttacagcctgtcacaactcaaggatcttgaggatttataaagtcctgtggtatccaggctctcactggagctttccacagccactttgaggtaggaaagcagaggcaactgagtttcagagaggtgacctgtctgagggtatgtggcggcttagtggtagaaccaacaccaacaccagtggtagaaccaactccagccccagagtgctcatctctggccctttgtattcttgcccccttcccatctatcaagatggaagggggtccccaagtcaccccaagaaaataatccctggaatgtgagcatgtgcggtgctctctcggcttccaggaacctcctcatattcagctttccaaacccccttggaaggatgtgatagggacattctcactaattgctacctgccttgtctttgaactttgcagattgggagtgggagggggcataggacaggaggtgttccccacccagcagaccactaagaatgattcacacctggcagttcagtgggaaaggggctgccttagtctcttggtgtacctgacaagtgctggtagcgagccaactgagcccctcagagcaggggcagcccacgagctccagaaacccagggaccagcagatgaccccaatcaagggagtggggtgaagcctggtatatctgacattgggagatttgtcagcttccctctggagctgcctccttccaccgtgcagctcataggcccagttaaagtgagtctcctctggcctaggcctgggttccagcctttggggccttctgtgggggaggaggctggtagtggcctagagccctcacttattcctggaatttcagaatcttctgctccctgcagcggaaatgggtctgggtttgagaaagactttgatcttgaatagatagtcctgcatccagtcttggattgccactgactagctgtgtgaccttgagccagtcatatctctggagaagaccctcacagagtttctgtaaggatcaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggggacaagacatgcgtggagacatttccagttaccaaggtaagcgcacaggtccctctgttttgaaacctgcaaagcactcagagcttcttaaattaggaagcatcgttcttatggaccccctgaggcaaagctattgctaaaagaacaatctgaatcagtgaaaccaggctgggtggctccaatgttggctgagtccagggtcagcacccactcaggtgttcagcttcgagacagcatgccttggctgaagcatggactgggagcgaaatgggtgctccttggcaaagcctggtcccgtcagccccaactcagaaggcgagtttcctgttgccatgctgagcgcccagtactaaacgcctagttaaaactctgggtctgttgttcggacttcctcccctttcagcaacctgccttgctttaggccttctgagtttggcagagaataatctattctaatcaaagatgtacagaaaatgataccatcttccatttgtagagcatttcacccactctgagttcatacacatatctaattagacaacgttaattctaaatagaatgaactagctcactaagccaacaagctccatttcctgagaattctggaaggaagcttcaagcactgtgagatcagttcctttagcctacagagggtctaagagaatcccattagaattagaaaaaaaaaataaactgagatttggaagatttgagtttgcaaatatatcatctaagacaaatggttttaaataaaattcaacttagggtgccaggccctgagcgaagtgctataaggaacagaaagtaagacagagccccagctcctgaggggcaaacagtctagctggcgtggccagacagtatatacgcaaattcatgggacaaatcaaagaaaggagagattaaactacgctccaccgtgatccaggttctcacttgccaggcccactttctttcctttgtccctcctggcactggccagatgtctgtgcaaattctctgttcctgggtttttcttattgggccatgaggtctacccccagggatatccccagggactttctgtactttaaagcccccagactaccccatttctgccgacacccctctaagccactacttctttctacagcaagccccaagggttcaatctttctcatttctctgaaagggatctggctctattcaagactaatgcttaagaagcacagttttcttgctcctcactttcttgctgtgttttaggggtttaactacagagaaagaaagtggaccaaaatagaaacattcagaaatgacgagatacagactcttcaaaagattccatgaggcctggctcctagtttatagcttctgatttccttctggaagcaccattggagtttggctctctgcttttaataccaagggtgtgctaataaaaaaacaaaaacaaaaaacaaagctgtccctgtgcagatgctgctcctccaggaggttgggtagagggcttcagaggggaatcacagtcaactgcaaatgcttctggcattctgaagtcctcccggtatgactgaggcattgcacattctacggcctcacctctgcaccatcccaagcttgcttacccagtgctgatgcctggttagccctcccaccaggcttcagtccctttccgagaattaccaaggttttcaaggacactctcatttgggatttaacataaccgagcccagagcccatcggtaggtgatctgaaattggttttctgagagaagaatctgagtgtgtgaatatccccttatcaaacctcagcctccctctccagctccccatgaagcttggttcacacacacacacacacacacacacacacacacacacacacagccaatgaaggtgaaagcacagcacagctgggagccccttctagatgcactgctataactaccacttccaccagagacaagctgcacttccctctagtctgagactcctctttgctgtggggcagagcagctctggcttccgctggggatcaccttaacctagttgtcatgggccacagggaagaattctccaccttgtcttcctttatatccatggattcgattcttcagtatctccccccttcagaccatcacaacacacatctgcatttttaagtccctctaagcttttgctactttataaagtccaagctctaattaaaaacagatttccctcccactttgggggcacagtgacttgcaatttaccatgactttctttgagaataatagtcatagatggattgggtgggagggccaggaggagtttactgcaaagtagttggattggggtcatcaatgacaatgagaacaattataaactttttattttaatgaacttatatactaacaaatggtataattctagagccaccttttgtttgcctcaagaaatagccaattcactttacattttgtaaaagttcttcaggcatttaaaagcaatgatgggggggggggtgatgaggtggaagcatgcaagggattggtggcaaccactttcagtttattaattctacttcctccaggtttctcttaggacctgttagactgaaaggaaatgacttttcaccccctctcttttcagtcactgctttatctcctcactagagttggaatctcagtggggaggaaagacggagtggggaggaaggacctgattatccaggactctgtctaaaatagggagagagatgtagtctgcctgctccttctggcaagaaggtgctttgtagaaactgaggcctgaatttttcttgaagaagctaaaaaagatcctttgatttcagggtggatggggaggaagtaggacttgacagcaccccaaacctgtgggcagggcctcagtctcactgggtaagatgagcccaccctacccccacctccgtcctgctctctccagctccctcaaagtccttggcctctggcctcggcactgcccagtcctccaagcccaaagacttgggaaggcgatgtctgctgccccccgccccgcaaacagacattccggaccccagagacaatgtggtggatcaagcctgaacatgggaaccctccatcacttctattcagttcaatctgagaccctttaggaagcgaacgcatgggctattctccaaagcgcacggaaaggggctccgtctgacaaccggacaggatatttgaaatcagggatgtctcgggaaaccctctaagttggtcctcgccccctccccacggaggttggaacagaaaaccgggctgtcgagcgtctgagttcggaggggcgcagggccacaggcgcgaaccgccaggaacccccgcgccagcgccagcgccagcgcccccgcccgcgggaggagcgcgcggcggggcggggcggggcggggcggggcggggcggggcggggcggggccctgccggctccgcccaccccggcgagcttctctctccgccgctggccgttggctgggcgaggccccgccccgaggctccgccccccgcgagcgccgaggctcccggaaaacggcagttcccaactgctgcgcgcgtcccggcggcgcgcagagcctcgtgcgctctcggggcgggatcggggcgggacgccagaagggtccgaggccgggtgcgcggggggcgccgtcctggaggctggggagctgcgggagaggagacgcgctcctgcgccttcagcccgcctgagcctggagccccccgtagtgggtcgctgcgggtcccagaccggcggaaggcggaggctgggacaaaagatggggccgccgcgcatctgagtgtaggggaggcattgcaggggcttcaagtgggatagaggatgttgggctggaggccgccccgcccaggggtgcaggatttgggccccaaatggaaggcaagcaactgttccccacccccgccccaggtcataatattgtctgggtactttaggatctgccaaatctcccttttcaagttgcacttccaagtctagatagcatggcctacaacttggtgcctgtgaagtgagcttcacatgaagtgcctctttgggggccactgtgggccctttgaagaaattctggcctggagggtctggggggcgggtgcacaaaggagcaggtgtgattcggggagtgggctggagcgtgctcttacggagcagaagtcagtgacagctcgttgtacataggccctgggctgggacctgtggaaaagaatttttttttaaaagatttatttagtcatgaaagacacacacacacacagacacaggcagagggagaagcaggctccatgcagagagcccaaggtgggactcgatcccccggtctccaggaccacgccctgggccgaaggcggcgctaaaccgctgcgccacccgggctgccccggacctgtggaaaattaatggacttcaggcagcgaacacgactgggaactccaggggtgggcaggtgccagccagggttattaaatgaggactagggtgtcctaaaagggctcggaggggaagtaggtgaggtgctcccggttgcccagcattagccttttgctatcagtcctcagctacctttgggagacatctcctgatggaatctgtaccgtcagtgcagtagggatggaggaagagaagtttgggaccttaactggctccccactaagatactcagagaaatatctttctttcacagacctggagtccaggaaaatcttttgactgatccaaagttccaaaggttctgggtatccaggctttgaatccatcaggcacgactattcatgacttagttgttaaaaacattatgggcctctggaaaggagctctttccatcgcaatattctcttctccagctagaacccaggggtgataaactctcatgacagcctcccgggagggagagaaggaggtttggcaatggcctcggagttggcttccatccttgggtctttgggaggatcacaaggcgtcaggtcaggattcaggttagccatggttcaagacttgcccaggtggcatatgtggatgaaggcaagttcaccggggcacaatgcccttacattcatctgattttccaacctgaggcagactcgtaggcagggagtgcctcattcactctgggcccctatggcctgggttttgaactggcacagagttggcatcagtggtgcacatacaggatcttgaaggcccaaaccataggcacatttagaagatccacatcagcgggatgggggaggagctggagaatcaagtaaaatcatgtaaaagtatctgaagaaatagatcaatttaactaccggagaatggaacctgagcaggccccacttgctcacactctgtaagttggacgtgccttctggaaacagaaaagccactaggaagttccattctcactgaaacatgaaggatttctgggtgcacactgggttgtctatgggccatggcagtaaatacttccctacctccaaggtaccttcccgctccctaaaaaaaagaagtatggagactacgtatcctagcctgtctgatcaccctgggctaacttcctgaaggaaaggggatcaaggaagcactaggcctacccacctgcctggcccaaaaaggttagagttgaaagggaaacatcttcgaggtgggtgggactctggtcctgccggtgcatcgagtcagagctgggaaggaaggaaaggcccattaccctggctggtgatatgagctctgactttgaggagcgaccaccaccgcatcagtgctctctggagcccctctctccccagggctggtgggccacgattggcctcccaggtcacatcctctgctgtactggtcttgcttggtcttgttctcactggctgtggcagagtgtttggtccctaaagcccaggaagctgagtccccctgcccccacatgaacatctctgagaggacaggagtcagctagctgctccaggacatggggacgcctctgtgtgtgagggcttgaaaggccatggagtgtgaaattctcagatgtgcatcatggctgcaggcactgatgtcaccataagttacacctaatggccctgtgaacacaagtgctttccagaccgtcttctgaggcaaactcccttgcctgctctgcaaagtttactgcggagacacaaggactcaggaggctttctggacttagggtacccccagcctacagggcccaggccttgcactgaggctccctgctttgctcagacagaaatcccccaaaagatgagctggagctgtctggcaagaagagcagataagaacagcaggattgggcctcaacaccccccacccccacactccaaagaaaaaccacacacacacacacactcacacacacacacacacacacacacacacacacacacaaaccagcttgagagctatcagaattctggacagtggttcctgtcaggatctgtgttgggagctgagagcaggagctcatctcacagggacgtctgcaaatggcaagtgaccactgtcaaatattgaacaaggccaatggggacggtcatgtctgaggtcctattcatggttacttcagccagaggcagagcccccagcccagcctggttcctgccaaactttgcctagagtgaagcagggaagcttggcttctctcctctgctctgggaccaccaaccccccttttgggaggcacagtaaagcatcggatcaaatggaacctaggcatccgctacttgaagtggtttactcctctgtgtggtccttgtatgtcctctgctcccaagacaccagtccctgcatggagcccttactggctgcatcatatggctagtacacccacatctccagtattgcaaagtttccctccctccctggacacatctctaatattaatggtggggccctcagatgagctttagccacaaattcaagacagtgaggaatccacccaaaaagtcctgagagagtgatccccctgggagtccaggcagaagcaaaagcaaaccttctcttgggcttccccctcccccaggcctcctaagtaaagatgggcaggaggagaggctcccaccctaagccgctagaacctgaggctacagaaccatcagagaagtctggaccatggctctggatgggagtaaggttggagacttggaaagatgagtagtggggcagaggcagttcaccagccatgacttacctgcccttgggcctgtgtctgccctttagaccatctctcttcgggtggcagcccccctgcacgcccagggagcagccgctggaggaccaaacggggggtggggggttatggtagccgagggaatcctcgtgaacttcagaaacacctcagtttctccctgccaggggcagttccagaacccagagtggctctgagctggggggcaggtgcaagggaagacagaagagtcactcggggcagagcttgctttccccccttcactctgatggggcagaaaaacaagaccataaattctctcagagagcagggcctttctttgcctgttgggagcccctcaccccaatattttaagttacccccagcatttagcaggcccgccaaggagtttgctgtaaacttcggagctgagaggcaagtctgccttaacttcctctgactgccccagtgagaggagccacggggcgggggcacagatggggtcattgagtcctgcagcccttcttcgttagaattccgggctgacttcttgatcccgggtatgttgaatggcatgacctgggaaaatttggcttgatgcctgggggaggcatgcccagatctcactgagtcaccattcagtccaaagcaaaaactgatgcttgtcttttctggttggagggagagttgagggacggataacactctttctccagatcaaatcaaaatcccaataggaggagataccttggtcaggatgggggtggagagcaaaagagcaatcagcaggcttggggcaggctagaaatattcatgacacagagcataggcttcccgtggccgagaaatctccaatttggcttgtagtaaatatgtaaacctgttaaaatacattgattagcaaaggatctccactcaacactctttaaacaccaacatctgttcccaataaataattcacatagtagatattaattagaaggcacgggaggagggaatggcagctttaaaaggacactgagatacctctttgccaagaaaggcaaaaacccacagccagatgtggaggaaaaagcaccgcgagaggcccgcttccctcttcctgttttggaccacgcacatcactctacccctgcccccagaaggcaggcagtgccacagctgcttcccacccctaggacaacagtgcccctggagacagctgtccaagcacagctggctgctgcccacagccatgagaggggtggccctggattcctagagctacaagccgtggagggcagctctcctgacccacccctccacacatcccctctggcaccagcaggcagaggactggttgctcagacatccactgaggatgggagaaagcatcatgtcctgaaggcagcctggaggctctgctgattaattaaaccagggccgtcagagacccccatctctgataaggagcagaagtcaggggccagtgatcttaaaccatcccagaggatgcagctcctacctggggttttggtgggggggtgggggtgcggggcttccaagccccttgcctccttttctcagcagtttccttgggagttttggcttctttagcagatcatcattgctttcaactttgggaggaggagggcttctgggaccccaccaaggggccttgtatttacactcctggacagagtgggtggtggggctgacttctctaggcaggataacccagttcatttccacggagcaggagggaagctggccccaccagctcctgggaggcaccggggtgaagtatattcatccagtcttctctgaatgaatagtttgtgccaatcattgagaccacctgggtgggaattgagatggtgcatgggggaaaagtactttatgccctcggacatctactctctatcaagtatttgaagagtctgaggcctgaagttgagaagctgctagaggtggcctgggccctacacctgccagcaagtgctgcccttgtggggctcttcatttgcacagaagagggttccccaatttgtgttggagagccgaggtcactgagtactgtctctgccagcactgtagcccactgagcccctaagctagcatgtaccctgggccaggaagccatcacacctggcacagggaccaaacagcaggtgggacagctctggtgggagccacatatctgcccaggtgaaaggagtcccaaagtcacccacatgtcttttgctccaggaatgaactgtgtttaattcctgaaagctttgttcttctaaagggcttggcttcattcattctttgttccagaatcccctggtgttattattgcaatgaccattttccttctgattggaggaggtatttgagatggaatgcaactacactgaggtgtctcaggatgagaagggaaagagctgggttgagaagggacagagccacactttcagaaccaaaatccagaaagaaagggaggtgtcaccctatggagaacccctccccactccattacaagtccaaaaagtcagagacccggccctgggcaggtgccatggcaactcctgagggtgaggctcagtggttggtaatcagtgtggacaggcaccagggtgaactcaagtgaggtcacagtgggactgcctcatgtttgtagggctgttgtagaaagggggtggcagctggctggccagtttcttggagaacttttaagtcctcacaccatcggctgcaggctgcagagaagaggctggggtggccaggaaagtaagccagaccttagcatttcttgtgttaaccgagggggtttgaggcatcaagtacaggattggccaggtgctgtgaaaagaaccaccacctaacatttcaaacttcattggaggtggggcagcagagggtaaatctcctgagtggtggaagcagggcatccctactacggagacaaatgggagtccctttggctggaggtcagtgtggcctctctgggcaaagagtgggtggttcttggctgataggctaaagggtggagctcgagactctgtcacctttcctttcatttaggatggtgcccgtggaagcctctgagtagtcagatagggcagccaatgatcagaccaccatctggagggatttaagttagatggatgatggggccactggccaagttaagtggctttgttttatccacaaggatcagcatttcttagtcttaactcagaggtgcccagattgcaaaagcagaaaataagagtgaatgaaaaactagaacaccgcccccccttcccaccccgcccccaagagaaagcattggccggcacagatccccagagttgcgaaaagcatgcctctggaagccagaggtggtcttcacagaatagtagattgatcggccaaagccaacctcccattcttcccccaccccacccccccaccacccttgctgtggctcagatgctaacatgctttttccaatgactcgtaggaagcttttgagtgtccagccaaggggaaggattatatcagcaaaggcagagtatagggatagaataaagacaatcagtgaaagacagggtgaagatctctgcttcctgcttcctgcttctctcccataagtccatcctaaatctgaggtcccgtggtctgggagggggcaaagcaaggggaacaagtgttttctgctacttccttcttttcctatttcctgagaaattcaggcaaggtcaagagcaggaatctcacaaagcacacatcttatttaccccactgcctgctgctctgccctaagtcttcccaagcccccagccatatatccaactccgtcctcatttcttgaggtccctggaatgtgccttactcccctctggccaggccttctgttccagtgtggagagcttttccccgacctgtttcatctgctcaaagcctgctcatcattcagatcgcaggtctaatgtcattccctggggagcaccttcccaggccccttggacctggcagctgtcctatgaatcactcccttgtggcgtttagcacagtttgaactcatacatttatttgtgtgattatttgactcacgtccttcccccatcccacaaggctgaccttgcctgatttagctcaccatttcccccagcttctcttacaatgccccagcatttaataggttctcaataaatatttgtagaatgcatgaatgaaagggggtgatatgagttctccttttcctcacactcacctgtgcaaccctcattcattgggcagttcacttgaatcactcggcttcccagctccttgaggcacagggaaagaagaggtgtggagctgcaggggctggttagagacccatgtgaggcccactagcataaagatgagacaggaggccattcaaaaagcaaacacaggaaactcaggagacaacattcaagagggatggcggggaggatggccagtgtagaggggtgggggaagaaggtatgaggaaatgtctcataagaagaaatccaacagcagaagcatggggtagaaccgtgctacagatgtcgtgagggaatggttatcaggcaccagccaggaaacaggcaggtgcaccctctggtgttgtgggcaggcaggggagctgggacagcctctttggaagaccattttttaacataaaaagcataaaatctttagcagtctctccaacagacatgcttgagtaacaaaggaggatatgcatgcaaggatagtagtggtaacctcggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttgtctcccgtgggagttgttaaaattttctaggtggcagcaggattgaggaaaagatgaaacctgggagcctgaggccagagctctcaattcattcattcgacaaatatttattgagcacctactatgtgccaggcactcttcccagccctggcagggagggtggatcccctgggctgctgatagatgaagatgggaagaagaggctcacatggcgtggggctgtgggggctccaagaggagaaagcgtcactaaggaaggagctagaatagaatggtcagaaagatgaggcaggaagtcaggagggcgctgctggcctgggatggataggaagagaagctgcttctctagaagagccgggagaggagccatccgggaaaggcaggcttcagatgggctgcaggcaggaagctagcacattttacagcttcctcctggcagcctgccctgctttccttgcacctcacaccccgggtctcagaatggcacagggctggtggcagaggagagaggcaagtcctcaggcaccacgaagctccacccagggactgtgacacacttttctgtgacttcagctctggattccggccctcagccactgtgcaatggtggagagaaacaagaagggtgggtgaggcatggtaaggccagatgcagtggtaggagagacaagggtgaaaatggaggaggagccagatgatcctcccacacagaggtggtaggaatggcctggagggaggcggtcaagcacagagccaaatgggaccaaaaggaagagagggtgttatgggatgaccaccaggcacatgtggttctaccgcgttctcgggagccagcaaacgtccttcagtggcttttttctgtccttcaggccaccttgaagtcaggagaaggagagggctggggggcagtggtgagggccaggagcgcaggaaaaggcctggagagagggggacggggatgccccaaaggcctgggttcgctcccatcctcagggaggatgcccttccttctatctgcacccttctaccttctacctggccctctgccattacgccaccttccagatggagccccacttcctagggttgcctgcttttattctgtcccattctctacactactgaccttgtcatttgacttgagcatcctggtctttattcccacctcttgggaaacggggcctgcccattggcagggcatggacaatcgagttgggctctctcagattccagataaagctgtgaggtacggtgatttagggctttcggcttcccctaaaggccaaggaggctttgtggaggaggagggccattctgagcccggaagggtctgtctggaagagatggaggcagaagccattagagggagggagggaggaaaggggaggggagggggaaaaaggggagggggagagctgaattcctgaggtctttttcctccttttgccattgaaatctgaagtctcacccacagggggtcaggctgctctttgggctcctggctcccatctcagcaactgctacttctagagaaagaaaacaaaaaagcatttcggggaagggacagcaggaagtgtggtggggaatccacccttgcaatccgcaggggccacctgagagtagcagcagataattctagggaagaataataggagaggttaaaaaacaacaacaacaacttgaaactgcttagaagatgggccgaggcagaagtgtggcgaacaaagtgccacaaacagagccccttctggggctgatggggtgggaggggaagagggtacacactcacttccacccacagtgaagccctgttcctaggggtgggggaggacggggcatgtaaggcaggctccttcccacagaggctcccaggagcataccagggtccctttgccctttcacttcccagaatggcctgccagccagtgccaacatttcctctgcttctgccctggggtccctacctcgccaccccccaccccacccccatctctgtggagactgtcaggctgatgactgcttggaaaccactctggtccttatagaccaaactttttccccccgcctttctttcaccatacacaggaagagctcacagatgccaatgcatgcaactgccacaatggcagggaatgttaagagatgccgccctgggctccctgtccagagcagaggcgcttcaggctgacttgtggcaaggagcagaacatgggccccctgggacctgggggctgggaccactgttagggctcccagagcgctccccccataacttttgtggggctccctcatgctctccatgtgttagactctactttaaatgtattttcagcttaacaaactctcctgggagcaccacgaagctacctgctttgttaaatgggtccttacagctccaaggcgggtcctgctccgcgtaaggcatggtctcatgaactgattcatgatctctgccgacaaaatccttatgcacagaccctaaggatttgtagacagccctcttctttatagaacccctggagcttcctggctccctccttgggactagaagaagcctcgtattgtcttgcttgaggtagagtgaacaggacttcgagtgggtcccaggtgtggaagccccttgtgttagggtcagatgagcttctactgtgctttctgctggtggtctcacccttccactggcttcacatgagcctcgtccttattgcaaggcggtcttggaagccacacttcccccacaggcactgtcatggtctcccctgaagttcaagtctgccattctccgccaccccccccccaatggaggcttctgccctcctccacgctgtggcccaaattctctttggagtgccctgtttccccaggaaacaaactgtcccagcgatcgatcccagctcggctcctcagaccaccctggtgctgacggttctcaattcagaaacctatatgttcagttctgcttttgagctttgcttttggtgatccgtttctcttctctatacacatgtttgatgatacatcctgtgtctcagatttcttcgtccttaaaatccagtccctaggggcatgcctgtttcatctttaaccaactgcctgcctccaccagctttctaacttgggtagcactttccaaagacccaaatcctagaggcaggatcctgccttcctccccatcctcccacgctggtgaagggtttggttggtaactgttccaggcaatacaaaaggaggactacaaggtgggggggcgaggctctggtgatgtcaatgcctgccccctcccagttttactcccactcacattcttctctagcgcacgctccaaccccccaacccctgctgaggcccctctgttctactctggaccacacgaggctccctgaatggactgcagcgatgtctcccagggagagctgagaggaggagaatgaggctggagagaagactggcgatgtccctggcgggaggccacagctccagcaggctgccctctgcacacagctgccctctctgggtctcctaatggtgtgattcccctgctctagggtcctctatgtcttaccgaagcatgttctaaatcctgtcattgtagagagttggatcactgagctttacttaagctacccggggtggcggggccttcgtccctgctggctccctggctgagacagcccttctctccagtggtttctcagcttctgtttcctttcggcagcacgcatccggctctccaccaggcattctgatgcacctcttgggtgggaagcccccaccccacacgattaggcaccatggatgttcaagagggacagactgtttgctcggcacctcacatgccaagattttgctgggcttcacgtggtgtggtttgtgctgcaaaaacactagatggtttgttttccaatctgaacgtgcttttatttgaaaggtatctttctgaggcttctgggaccttcagatggaatggctgggtaggaagcctgaactctgggtgggtagtggggagggtgggagcaggggtgatggggggagagtgtggaggggtccccatagttggtgttgctgagaggaggaggctgaaaactgagattgtcccagatctctgggtcaagttgacacttcagggggagttgcaggaagagacccaggcaaggaggactctgaaggggtggggaggtggagagaaagagattaggaaaaattgctgtcccagaacttaagagaagcgtttcaacagagagagctccgcctgtgacctatgtcaaacgtggcctagaggttccattttgaaggtgccagctgtatcctgtggacttagtaaggctggtagtgagcttggctcctgtggtggagtggaggggctatgtgtcccccgcagaggaagaagggactgccctgttagcagcttgaaggggcaatgccctctgagtgggggagggagaagactgagggccaagtcctggtgggttggggaggggctcggacccggaggagggtgcctggatctgagagaccctgggagccaggccagagctgccagtgatcacaccggaagttgaaagcctgccaagtgggagatggtcagggttcaaggtctccaaggaggctgaggcaaacgggcaagagcccatggggctgagtattggtgagacagggtctaagcagtgtctaagcagaaggaagaaagtgaatcctggatgctgagaaccccccccccaacaatgggactccgggacctggagttctccatgagattgaaaaatagaaacatgttttaagatgaatccttgtttatctttgtaatcagcaaaaaaacaaaaaaaaaaaaaaaaaagagaagtcaatttaaaaagccatgttgcctgaatgcccattaactgtataatggataaataaattgtggtgtatttctgcaggggaatacattacaattccatgcgatagcatagatacaccccaaaaacatataactgttgagcaaaagaggtgagacataaaagacaggtgctatttgcaatcctttctgtaaagttcgacaaacagcaaaagtaagctgtgatgttaggtttcaggatagtgatcactcttggggaaagaggtccctaggaaggggtaccagtcgctccctgggggctgctactgttctactcaccaatctcaaggccagctccacgggtccattcagtcagtgaaatgcgttgcctgtacattgatgacctgggcatttttctgtgtgtttattctacttcaataaaaagttcactttaaaaagagactatctaatgtgaagtatttcccttgggctccaaggcctggctgcttctgagatggtctcctgtagaagctggacatcttcctggccagctgaaacaaaagttattaaagtagcagtgattcttcctctccagtgctctgggtgaagagcccaccctgttcgtcttctccccctgacctcgtcagttatggtgagacacattccagacgtccaaacacatcataaatactaaaggccattttccctctggaatcctccctgccttgcgtccagtgtctcctgcagcaagacctacaaccatcgtatcacagttcctttgcctgaaattgaggagctgtgagggctgtggtggggggcctctccccctgctggcatgtgccagcttcccccaacaggctggacagggtccagctgccctggattcacctgagatgggaggtgggaagaggggatgcctttttctaatttgtccaaaaggtgcccaagagatcctcagtatccctgctagaagttgttgggccaacattgtcgaggtcttacaatggcagggccagaaaggagggagtgtgagggttgaaccgtggcattacaccaacagtagtggtggagtatagaaccttttattcagagcgctcaaaggggcgttacctgtggccagggctttgtttgcccaagtcctggcaagaaaggttggagcttctctcccggccacagttgctctggctccctgggagctggctgggtggccatggacagtgggcacggcaggctttcttaaacctctgtgtgttgtgtgcagacagggaggacgcctggccttcatttgtaagacatgtgtctggggttccccgtgtcctgctgtcattctatcgctgatggaatcctcctgcaacctgatcgatggttctctagttcttacttttgatgtgtgctggggtcgggggtacatgaagagcccagggctgcccttcccagcgccctcccccagggggccttctgctcgtggcagctttgtagtaggcattcagtggcatctggtcacagcccaagacatttttgctctgcgagacacctttttttttcttctcctgttttcaagcattctccaaggctttctacgggggtttttgcgctttagatagtttttttgatgttttttccccccttattgatggccacatttcatcctaggtcctttcccggaaatcgagtacctgtgggggcacagctagggccggccctctgccaccagagcgtgaaatatcacacgggcattaagagcctcgctgccaccctgaggacgcctcccactccggctgtgtccatttggagaatgaacccagcccttttcctatctttatggatgagaaaactctgtatttgaggaagcagccatttatcttcactaagagcctcacctccacgcctcgtcctgatgaggcagtcagcagctggagccaggagaagggagtttcattctgaggagtgaaatgacaactgactgatgggaatcacatatggaactcatcatccagaaaagtggtgcaactggaaaagatgaaagttctagaaagctttggggacatctcagggcaattagcaaaatgaggtttagctatgaaacccagtgcgatacagcaacgtgacgatcgtttgcttatctatgtacagtggagtcgagtgagcagctcctgccaccttcttcctccctgtagaatttctcgtcagtcagagccgctgccatccatccagctgccttccaccaattaattctctttcgctggctcctgcaccaagcaccccatctgattcctccacttgtgatacgtatgtagatacagttacacgtttgtctttgcttttccgccactccctgggcccaccagtggtcggattctgtgggtaaatgtccttactattttcttccaacccttgagcatttcttcgtgcctactgactggccctgggtaggtaccaactggaatcccagtagagtctgatgccagttgtcctttttcttagttgggaaaccaccctgattccatttgaaccccactcccagcaacttagagccctccatccagcccatgcttttggtctcagaggccctgcctgacttgtttcctgcattggaacaaaaccctcagaggagaattagcggaagatgaatccagcagacagagtgggagtgctggcacgaaatggtgaaccagcctgcaataggccgggccacagagggtggcggcaaggaatcgctatgtgcggactgacctggagatcagaggttccagaatccagggccagttaagccatacatggagtatgaggcccggggagatgaagaggataaggcagagagggtgggtgaagaagacccccaaggtataaggtgaaagggagaggtgcgaggattcatgctggggcaggatgctctgtggaaattgagtggctgggaggacaggcattctgggccttgggagcagggaagggaggaggggaaataaatgatggcccttttggaccacatctaagcaaatgattggcaatgtgatgggaacctctcttctgcagccagacttgcgctgcttggtgggccgcctcacgcctcctttgaagggcttgtctctggcagttgccgcagcgcctgccccctacccccaaacccctcggaccctccacctgtaccaacaacagagcctgctgtcagtccactttcagccaggttgaaagggcctttttcctgggcatggaggtggccgcatcctgcctgtctcctcctcctgcatgcccccaaatctaaagtactgaagcaccccccacccccaccccaaggcctttccctctttgcttcttcatccccagcaaactctccagaactacccagccctcagccaatgtgtcctctgggacccatcaaagaaagacaagaccagccgctcaggcctccccgctgggccccacatgccttcatcgaaacaacagggaagcagcaggaagcaggcctccaagggcttctcctccttcctattctggggattcattctataatgtcactaaagagtatctgactttttggaggggggctggaggggagcgtatctaaatacctgcagcttcccacccccctcctcgcttctagcactctcagcctgctttccaaggcctgcccggggccctttccctccactctagacaaccaccatcgccccaggcctctgataacagagagattttattgtctgcatcccatattttatttagcattttatgatactccatgtatggcttaacttgcttttaatctctaagactatagcaaggtctagctagataatattgaagacaggcctgaccctgcactttttgtaaagcttcccccacccaccaccactccctgggaataaatgaggagcttcagggaagctgggtggccccgagtaatggtggctgatggtctagtatgaaaaggtattgagtacgcctgggcactggccatagacagcaatgacattggctctgacaactgatgacatttcagtgagggtggaagagaggagttcaaggacaatgaagaattaaacctggtgctggggacatgctcaggagcaaaggaatgtaggaaaagctcaggtgggtgcagtagaagggaggtcatgggggtaaggagagggagcaggaaagatctgctcaggaaggatgtggactcagacgctgggctgaggggacagaccttaggagccagccctttgtctagtggacaggctgggccctgggaccagagggctccataatcagtcatggcccaggcagggcagctcagagggagggtagtggaggggacctgcagggtttggggcacaggggagggaaagtaggagttccttcccagggcagagctggggtccccagccagggtccaggatggctgcagcagggcacagcccaggtgggccacgaatgcaggccaacctgaactgaacagtggaaacgataaaccacgcttcagatgtccttgcatttttgggagggcccaacagagtggggagtgggagagagggactctgatatggtttcattcttggctgtggttgccctttctcttcagtaacagctggttagaagtgagggggcaggggaggctcctggtggggtgccgggaaaagggtttacatcccagacaagcacagtagacgctaagcagaggggcccccaggggaggcctggacagccagtggcttttctccagggagcagatcttgctttcctccatcccctgactggttcctggaattgaaacctcctgacttctcctgaaacactttctattcttctgtgcatagctggctcatcttcctccctctagctcagctaatgtcctctcagaaaagccttctctgatacctctcagctccagtgcccaccccacccctaagactgtcctgtcaccctgttggtcctgttttcttgacattctctggattgatcttgtccatctctgtttccttgttggttcctccctagagggtaaattccatgaaggtggggttctggtcattcttggctgcagctataccttcagcttctagaatggggcctgccacagatgggcactcaatgagtatttgttgaatggatgaatgggtggatgacaacacatggacgaacaccaggtctctggggtgggagtcctatcaaatctccttgatgctcatcccgtggaggcagggaaacaccccccacccccagatgcaggagttctagatggacactgtaaactgggcttcttctcagctttaacataggcagttccagtcctgttctccttcctagccaattgcactgtcaccactgcctctgagaccccagcgtggacaatgcaaggagaaggaacagaaggcaccttgagatttccccttgctctgcaggttctgaccacctcagagttcagggactgtctgacagtgggatagggaagctcagagagaaactttgaacttcactgaaggtgggttctagaataggttgatgatgcctttttctctcttctcaggggctccttccctctttgtatacttgtgagggaattcaaatcttttatttttaagagataaaatatctgggtttggaaagaggaaccccaaactgacaccagtttgggttgggtatatttggggctggacaaaactattcaaagagcaagaatcagggggaatattgcccttaaccccatccatgtcctcttggcctgtttggctttggccaggtccctcacccctatggaaagtctggaagcatcctatagcctccccaaagagtgttcaagcctgagccttggagaccctctagggctcggtgtctgggccaaggagccgtcgagtgaggcatggccttgaactctccacacttgcccattggggaccaatctgatgagcctctgcagcctccccatgctgccgatcccacagagcaacatgccccattggcatttcctctgcagggacccaccatctcacacatctgctccccccatgtcaccctcacctcccaaccctgctcacttcccactccttatcccaatcctctgtttgtagtagggctcttgctgtgaaagccctgtcctgctccctggtcttgggtccgtccctgtgggtccctctgttgcttgagccacagggtctcagggcagtatcctctttccttcacagctgcaaccacctgccctatctttgcaggctcttcttcctggtctcggcagtggccttggagcggtgctccagctgcctggccagtcacctcctggtcaggcacggagtcctgtccattttatatgcttctctgccaggaatagtgaggttaacagcttaaataaagatgtccaagaaatctcagaaatgacacgaagcatttgtccctaaccaaacagaagtgctggtggctggcggagcgggtgctcatcctctggttggttctttgtggtccccacttcactttcatacctctttggattttcttgagtctcccaaaggtcagctgtgacccgggcttgttctggatattgtatgtgcattcacaggctataggaagtcaggggcaatgatgggaggccagaaacagccagctggagcagcacaggaagatcccattgaaagcagggccaccatgccagatggtgtaagctgagacaggctgagatcgatggggaccatgacagatccctgcaccggtcgctaggccttcctggcagcacctggactcccgctggtcagagaagaccaagcaaagggtcttatgccacaggaagaaggaatttctaggcaggacacccacactaaagaacttcaaagaaagtagtcctctttgggactgaccctgcctgatagtctggttcataagccaaggtaatggaatccaagttgggacagcttgttgcaaaggtttttgggaatgtcacttttgtaaggatcaggtattagagtttctggggtttgatctcactgctgttctgatttcaggggaaacacagatttaggaggttagaataaataaagttaaggggacaaagggctaagggttagccccaaatagccaccaaagcagaaacctgtgtgtagcactggggatcctgccagtagagaaggtgcaggagtggctgtggaagctctgaggtgccgttactagcaggaaggggcagccgagagagtgggaggattgcttcctaagggcctgggtggggaccaggaagtgctttagtgcttaagcaaggtccctggttgaagggcttggaagtgcagaggtgctggtggcagggccctgtgtcagtactatccttggggccaggcctctctggctggtggcctggccttgaacttggtctggatagccagagactcttcctctacaggggacttgcattctaccagcctcaacttttcaggaagagaatatatacaagaacagggatgggggtggtttggagatggggatgaagctttgggctcgtgatggactagggtgacaccaagtctcatgatggactggccagtttccatgccccaaaaaaacatccaggagcaagggagccaggaataaagcccagatagagaagcggccagcattacagtgaaagctggcatatgggagcattccaataggttctaggaagaacaaaagaggctgtggaaataaccaccagtgtctggttctatagcaatacattagctacaatactgggagttagcaaactagggtttagttctgaaagaagagtgtctaactctccagtccccttcagtagtatgttgagggccaggctgagtgagtgagccagactatggaatttttacttaagtgaggttcagctagaaaaggaagggacaaagccaaccctgcctacccaggagattctgggaaggagaagagagaagagaaagccttctctggggttcagccccagagcatctggaagagagcattcttagctgagtactgccaaaacaaagggcgagtgtcccacggacctggccctgggcagactgaggggtcacagagtctgagctttcttgagctgtcctggttcccatgtgctttaggaaagacccagaagaggctggctattcagtcagaggtgcctggtatagtggcacctctagtgctgacaccacactagaccacatggaggctgcagccggtgcagagggccagcaggagcactgctcagaccacagaaggagccacgacgctgctcctggggtggggtggggttgggggagaggggtgggcagagagcctcaccctgaaaaccagagcaggccacacatggggcctcagagagactctccattattgaatgggactgaactttaaaccagattgaacatatgggcagggttttttgttttgttttgttttgtttttgtattttaatttttttgtttttcttaagctatagaccaaataaagagatttcattttctctgcccaattgtcatgttggttaaatgtcacagctgcggggaggtggggggggagttggggtgactggatgatgggcactgagggaggcacttggcaggatgagcattgggtgttatgctatatgttggcaaactgaactccaataaaaatataaatttaaaaaaatgtcacagctgccccatcagcccatttttgtcaggggatgtggccctcctgccttcaagaggactccttggctgtcagcattctctggtctttcccaaggtgtttactgggtcattagtgtggagagccagagaacaaagcgctcatactgactgatcccatgtgtggccttgggctaaacatcctgtgtcccacagattattctgtgtccagagtctgtgcttggatcccagagacatgggcctggctgctttgcctgatgatccgtggaggctgggtcaggggagtgcctcctgagtgtcccctaatagaccctccaggaaaaggggacaggcctgcagggccaggggtttctggcagccacaattacggtagatgggggagccagagaggccagagttagagaccaggctgtatgttagcccttcctccaggggcaaggaggactaagacctcagctcagatggaggattaaaacatagtatcataaaagcttgtaagcctgggaacatcctcactgggctcatgggccaggaatatgcctggagcagggtctcttgaccatgggtgatggtatggtggcaggaaaagaaggtgccttcagtccccagtgggcagccagtacaactgaggagggcgggaggagtctccccaggtcttggtcagtggcccaggcatagcacccacatagcacccactatgctatgagacgaaatgtggaagttgtccagctggggctgggacccaggccatcaggaccttgtccatctttttgccatccgcagcatgtcccctctaccctcgtgctcacaagatgctagagcttctccggataccatgcctagagggaagggacagaggcctgatggggcagatggggcccttttgggcctatcaccttcacttacatctcatcagccggaaccacctcacgcatcatccctaggtgcagtcactgatgatggccacggaggaggaaggaccttggggtgcacaccagcaccccagtcaactgtgttctggcatagctccctccctatctcctcctccatcctgccaaggtccctcacattgagggcagagtcctggcttcaccagccttcctgctggcccctaaagaatagattaggattttatggcaattcggcaaaaaacaagaatggatatggcctctgccaccacagaatgggcagtggtgcgagaagtgtaggttggagacagcacaacaggttggaaggcatacagaagaagtgtgactctcagtctagagggaacaacgggcacggagagcgtccaggaggtagagttgtcctggctaaagcctaaaggatggaaaggagcaagccaggggaaggaaggcgagagggtggcaagatgacacagctaaggaacagggaggaattccgctggaggcccgggaagagctgcggcaggagaagcagcaggcccaggccagagcacatggggccacatcgagaggagtgagcagagatggcacccagtgcaggctggagagaggtcttagccagccagcagcacaggccaggctggggggtgggggccagttaggagaccatggcagttaggcaggcagggccaatgctcagggagggacagaggtatggagaaagagtgcggagacagaccatacaaggcttacagaccgacaaaggggtagacgtggctgtttggagagagagtgagaaaccaggtgtgtggaggcggccttcagtgagggggaggggacacaagggaggggccactgtagacagaagggaccatgtccggttggagaggctgggttcaagcacatgggggaggagatggaagatgtgggtatctagtctaggtgctcagcagagttctggcctgggatccagttatactacctgccgggggccaacaccagggatgaaactttcctgctactggcaaccagggaaacaaaggcaagggatgtacaaatgggtctttgctttcctttgggccaccatccaacataggcagctggccttgggtgggcacctgggagagttcccagggatctccctcccctgctcccactcatcccaccccatcccatgccatctcattgcatcccctagaccccagcctctctcctgtctcctggcaccccaagggctccagctccccatgtagggagactcatattgcaaggttttgagggtagcagtggggcatacctttgggctttctggactgttcccaagggatgccaaaggggcacagccctgcctccatcagagtggactttggtgcacaccacactttcccatgcggggacctatcacagacgccttcccctctaggatgagaatggggttatttcccttgttaggagttcagtgatccctatcatgaatccagagacttctcatcatgggctcctggagaggtggtggaggcagtgacataggcttttgtcaccagatgtgctgctgtgaggctgcttgggaagttccatcttccagaaaatgaggagcctttgagcttttgggagactgagtagggcttctggcatccagctctagtgtcccagctgccaagtggggagaagggtgtggttagccagctcagacgtaggtatggctgagcgctgcttctggctcagtagtacctcatggcctgtcctgagacactctgctggcctggcctgagagcatgtgagctactgggcatccatagtaaatcccctcatctcttgaaccaacccaaggggctttggtgaagaacctcgcacaagaacgggagtggggggaggaagaaccccagctggccccacagagaaggggcttgagatgagccaggcagagacagaggtaggaaaggatcccaggatggaaaatggggtgctgggccaaagctggaagacttgggaggccccaggaggggagtagctgatttaagttccccatttgtagaattgggatgagaacagtcactcattcattcattcattgaacaaatattttcaggccacaatcacatggccaaggcctcaggaatccatctatgaacaagacagacaagtaccccacctttctggagctaatgttccagctgaaagggtgggaggaacaaaaagaatgccaaacaaatgaagtctgagggctgtggtggtggggcaggaaacaaacccaagggtggtacaacccccctgacccagcctgggagccacatgaggagcagtctcttggtgccgggggtcctcgagaggctgggtgagatgacgggcctcggcagagcacctgcactgaaggccttaggtgttatgatggcgaagacaagaaggatgcttagcatttctttagtgcctactatatgccctctcttccctggttggcagcaacagcccctttccacccccgccccccacccccccggcccaccaagttccctgccaccccgagtgagacagcttagtgggctcaggggagagcctctgaacatgctctttgcccaaaggaatatcctgcctgtgctagggccaggaatggaggcacagccctggggacctccccccttctgacagcctagcctcccccttctgaccaccttctgagccctgagtagtgggagaaggtaaagtttcatttgccaaggaggtaggatggcggcggggggaggtcagcgggagccggagggagcctgggtgaagcgatgctagaagacagaagggtgagcacagccaggagaattgaggctgagtggggggtagggcagggggagataagaaatagcccttggggagacggtcccaggttctgcagggctgtatgacaccctactttctggggttaccctccatggcacttccccttgggtttcacggcaaggtcccttagcccctgagctggacatgccagcaggtgactcggcagtgaatgaatagcagcctcttgaatgaatagctcacggcctccccaaatacctaacctcgctgagccttggtaatctccccaggtaaaatggggcagcatgtctctcataggatctctgggaggaaaagaaaaacatgatagagcatttctgattctcaaaaggatgtctgacccacagcaagtgcttgggaaaaaactgagcactcacggtaggattcaggagacctgtgacacgatgcgtgaccctaagcgctctccagcccagccccgtgctcagccccagcttctggccccaccaaaccgccaacctctctccaaatggcctctggcccctttgtggcccctgctttttgttcaggttcgtgtgttgtgacacccctctgatcctttccagagggctgtggggtgtggcagctggcagctccggtccatccaggatcagggatccccccaccctcacagacctgaccgtgctgactgtccccatgcgacggaggactgtccctccacatccagccctgcctttctgatagagccctgcctgtgacgtggaagtgaggtggttgcatgaccccgtggccctccttggcagcccggtgtggccctgtgaacagacacaccaacaatcgccacatgtgggttttgggaagcccctcaaggggacttgcctgctgcccctggctggaaggcatacaagcaacgactgccataccgaccaggagacagaggccatgttgtgaggatggaagaggaatggctaaccctggcgcccctgagaaccagccctggatggcctctgctaaagtgagggagagacatctgtcctatttgacacccctgttttgtgcaggcaagcctgatccccatagacaaaagtgtagctcctcccaccttttctccctgccttgccctttctctccatgggcgctgatgaagcatctactgcggggagagcagaggaggaatatggaagcagctagaggtgatttagaaagggtcggattccaagaaacaaggcaacggacgtagcgccagaagaggaggacagagcctggggaggattcgtcaccgcaggggtggtgagacaaaccttccagaagagcaggggaaggcaacagggacttcctacccatccatgcctaccccagttctcccctgggggggccggtgcactgcctcacctccccactggcccatgaagacccagtgccccttcctgatgaggcagtaggtggggaggtgggggtgccagttgggtgagagggtgtttagtgagggcctggggccggcaatagaggagaagggtatccccagacctacacattcttcccaaatcaagacaataggtgtagagttgaccacggagatcccacctcatgcctgagccccccatgctgtccgtgtggcttgcctctcagagcgggcttcctctgggtccctgcggagctccgctcagtaaacatataggagtcctaccgtgtgtactacatgtacatggggccaagtgctgaggacatcccctcgcagaggtccctgccccgcagcctccagcacacgctgccctgacaggccggcccaggatggaagcgtgctgctacacgattaacagccgctcctctgacgaaatcacgtcctgttctgtagcctttgtagacctctgtggcctgactcctccagcctggcaacttctgagctctcagcgtgaagcaccaaagggctgagcggggtaacgggggaccagccctcaggagtggagctcacatgccacagccaggggcttctcgtccatcccctactcctgtgtctgggcccctgagcctccccaccggtctgtaccttgtccccgggggacagggggctgcagggggggcctctgtcaatgggtagagaagaacaaggagacagcccctggagcaccctcttgaggtgctcaaccttccttgacatctgcccccgcccccaccaggccttttctttctctttcctggctttgcctcacctccaagctctcctcctcctcctcagaagggactattccccagcatttggagaccgcgtctcccccagcgcccccaccaagccggctccctaacccaggcttgccccgcccccacacagtgctcacgcagctgtctccctcccggcccatcccctcagtctgaggccccgctgccaaccccctgcctgtcccagagaggcctccacagacacttgctgcgcccggaagcctgcggttctatcagctctccagtggctgccacaaactgctgtcttggagaaagggtggctcatccccctcagcctccccgcctgcacccccatcccagccccaagcctcccggcatcatctgctccacctccaggcagctcggagccaggcccccatctgccctggcagcctggggcactggggctttaggaccccagggtaggacagagatccgggcccccagcccccaggcccctgcaggggagctgcttaatgaccttgtgagcagtaattacaccccaggacccgctcttaataaccacgtattctccctgtcaatgtgccttaattgaaaatgagtaggcgatacaagttgctgtgaagttggctgccaagcccttaacgtgatattaattgtagtaattagtagtcactttgtgttggagtcatctataaatagggggtctattagtttagcaaaagagcgtgatttaaaatgcaaataaaagcccaattagacagataaatcattcgtctttcccagcaaattatcatcttgggggaagatgggggcagcagccactttgaggatgattggtcagttccggggctctgggttattacaccacgtgagtggcccacttgggacactgttctttaaacaagtctgttcagggtccctcaggaggctgtcactccaggggctttgaccaggctctttgtaggcaggactcttggccaggctcctcccccatctgcttgattggtttcctttggggacaccggagcactttttttgtttgtttgttttttttgtttttgttttttgtttgttttttttcggagcactttttaaaggcacagtagcagagcgtgcctctgggtcctggggaatgggctggggtgtgggaggagtcccatctttaaatgtagctcttcaccttcctgagggaacccacagatgccatatattgttctgtgaccctaaagagttaaaaaacaaatagacccacaacattggtcctggggtagacaacttactctccatttcctactcccttccacaaaacctatggaggttattggagtcgcgcacgtgcacgcgcgcatgcgcacacacacacacacacacccgcagtatttctcacaggctttgggggaacattggaggtagaaatgactggatgaagaagaggccagttagggacgtgttaaggccagagggacgtttgatcatctagttcagccttctcaaaaccttctcccaggcctgtgtttcccaatctcacaactagggaggtggtgagaagtgtctgggcacgtgggtccttccctcttggtcagtgcagttgccagaaacctgatgttcagagcccagatcggagttcttcccacccccacatctgcctcccaccatcccctctgggagtccatcactcccttttggacaatcaagcctgactttttcaccgaatctgcattttaatgagtcaaagctgtgagatgaggcagccaggcccaagcccaggtaagaacagtccattccaagaggactttcccatcattgtccaagaaaccaggggagtgaaggcagtttgagagcattatcctttatttgatctatcatcctttcttttattacacagtgcttgcaacaggtggtagtacttgtgatttttaatgtcctatttgacaaaataaattgttggcaatcctatgtggatcccaagaaatgttttagaaaatttttccaggtataaaatccaaatgtctggtcacaaagaagttgagacttgaggccagatgagtcagctgttttgggggcagggagagagtgaaggaaggggaatgtgtgtgtgtgtgtgtgtgtgtgtgtgtgtgtctcggggtgggggggatgaaataggcacgtgtatcagcaaagatttccctctctctgaaatagcataagaagactgctatatcctagataaggaactggaaggagagccaggcactgtccatcccatctccctgcatgacagatgaggaaatcaagcctcagggaaggagtgactgggccaagccacacggtgagtcagtggttcagaccctggctagtacacaccttccgtgcctgccccttgtccttgtgttggccccaaaagcaagcctgagagttgatgtcataggatacatgggctctgccttggttggctgttgaccctctagttctgcatggggactgcttgttgactcccagaaaatagaaaacagccctgctgacagaccaagaagttccgcgaggaataaagaccatgctcagaagagcacacagataaggccactccaccccagccactctgagtgaaggtgcttctccaccagtgacagctctggccctactttaatcttcatgcctctaagatataaacagagatccccatcactgagttgcccccacttcttgtggcacccaatcccagcctgccggtgctttgccaatctctcctcaaatcactcagcacaaacctcaaccctttacgaggacttactctcagaatcttccttctgagatcctctggagatcccgtagggtgtgttctcctttacctgcagcaagccaactaaacttaacttttttgattacagatgtgttcctggtggcatttggtggttgggctctgaacatccaacagataatgtcaacaggcagtgtttcaggcaatgcggtggtgacaaaaagcaacagaattcacaacagtgtatggtggggacgcctgggtggctcagtggttgagcgtgtgcctttggcccagggtgtgatcctggagtcccgggatcgagtcctgtatcaggctccctgcatggagcctacttctccctctgcctatgtctctgcctctctctgtgtgtctctcatgaataaataaagtctaaaaaaacaaacaaacaaacaaacaaaaaaacagtgtgtggtgatagacttaccggtaactagacttaccatggagatcattttataatatataacaatattgaatcactatgacttatacctaaagctaggaggatattgtatgccagttattcttcaattaaaaaaaagaattcaggacgcctgggtggctcagtggttggccgtctacctttggctcaggtcctgatctcagggtcttgggatggagccccacattgagctccctgctcagcgaggagtctgctccctctccctctgctgctccctctgtttgtgctgtctctcaatctcaaataaaatctttaaaaaaagaacaaaaattataaaattcttgaaagaaaacatagggataaatctttataccctcagatttggcaatgcattcttagatatgacaccaaaagcataagcaacaaaaggaaaaagtaaattggacttcttgaaagtgaaaaacttgtgtgtttcagagaacactatcaaggaagcaaaaagacaacctaaagaatggaaaatatttgcaaatcggatatctgataagggacttgtccctagaagaacccttaccactcaatagtaaaaagacaacctgatttttaaatgggcaaaagatctgaatagatatttccctgagggagatatacaaatggtcaataagcacaggagaagatgcttgacagccttagtcatacgggaatggaaataaaaaccatgagatgggggcgcctgggtggcacagttggttaagcacctgactttcggttgcgactcaggttgtgatatcaggtcatgatttcacagtcatgagatggagactcatgtcaggctctgcactcagctcagagtctgcttgagtttctctctctccctccgcccctccccgccttggtgtgccacacacacctgtatgtgctctttctctcaaataaatcttaaaaaaaacaaaaacaaaaactgtgagacagcacttgacagtaggacagccatgatcaaagaatcagataaaaactttggggagggcatggggataactgacccctcaaactcttctggtggccatgtaaaatggtacatccacattgaaagtagtctggcataaaaagttaaacatagagttgccatatgacctagctgttctactcctaggtatatacctaagagaaatgaaaacctatatccacacaaaaatgtgtgcataaatatttatagccgcattattcataatggccaaaggtggaaacaacccaactgtcttaactgatgaatgaacggataagcaaaatgtgatatagccatacaatggaatattattcagccataaaaaggaatgaaatgctattatatactgttacaacatggatgaaccttgaaaatgttatgctaataagcaaaggaattcaaccactaaagactgcatattatgtccagaattggcaaatctgtaaagacaaagaagattagtggttgcttaggtagagggatggtggggtggaaagagtgagtgatagctaatgggtatggttcttttcaaaatgatgaaaatgttctaaaattgactctacagttgggatgcctgggtggctcagtggttgagtgtctgcctttggcctcaggggtcgtgatcccgcagtcccaggatcaagcccctccttnnnnnnnnnnnnnnnnnnnnnnnnnnnnnnnnnnnnnnnnnnnntagaatgtatctttttcccttggaaactcacttagcattcgtaaattgtcaagttttatcaacagattccttagtcaaacggtgatattgctctcctatggatcaggaaagcatacggagtagcgttagcttaaaaatgaggttacaacatttgttttaatacgtatcaagaaagtacccctgttaagatgtgaagcatatatatcaggaggcagagacacaggcagagggagaagcaggctccacgcagggagcctaacgtgggactcgatcccaggtctccaggatcacgccctgggctgcaggctgcgctaaaccgttgaaccacccgggctgcctgagtcaatgatgattgtacttatccctgaatatattaattatactactgaattgtatactttaactgggtgaacatttggtatgtaaattctagctgcttaagagaaaatagacccaggcccttccccatggaggctccattctagaggagaaagtcggcatgaaactaatcacctcacaaaggtatagtttctcccaacacaagggctgtcatggcaaaacaaaggactatgagacatggcgaggaccactgcatttagcagggaacaggtatccgggaaagctactctgggaaagtaactctttttttttttttaatttatttatttattcatgagagacacagacagagagagaggcagggacataggcagagggagaagcaggctcctcacagggagcccgacgtaggactcgatcctgaatcccaggatcaagacctgagctgaaggcaggcgcccaaccgctgagccacccaggtgtcccagaaagtaactctttaaaatatctttttctgtgcatgtcttttgcccatttcatgattggattgtttgtttctttggtgttgagtttgataagttctttatagatcttggaaactagccctttatctgatatgtcatttgcaaataccttctcccattctgtagcttgtctttgagttttgttgactgtatcctttgctgtgcaaaagcttcttatcttgatgaagtcccaatagttcatttttgcttttgtttcttttgccttcgtggatgtatcttgcaagaagttactatggccgagttcaaaaagggtgttgcctgtgttcttctctaggattttgatggactcttgtctcacatttagatctttcatccattttgagtttatctttgtgtctggtgcaagagagtggtctagtttcattcttctgcatgtggatgtccaattttcccagcaccatttattgaagagactgtctttcttccaatggatagtctttcctcctttatcgaatattagttgcccataaagttcagggtccacttctggattctctattctgttccactgatctatgtgtctgtttttgtgccagtaccactctaatgagttacattttatatatccaaaattcattcatttgaaagggacaattcaatatttagtaaattgtgttgtgcatccatcaccataatccagttttagatcattttcatcacccagtaagattctttaaatgcatatacagttaatccaatccctggcaaccactaatctactctctgtttctgtagatttgcctttcatggaaatttcatataagtggaatcatacggtatgtgatgtccctcgtctggcttctttcaactaagcatgtcttgaagatccacattcacaaaactttttactactgaacggtactggactgtatgagtagatcacattttgttcctccattcaccaggtgatggacaagtaatttgcttccaattttttggcttttatgaacaaagctgctccgaacatttcacagcaagccttgtgtggatggatgtcttcgtgtctcttgggtagattcctaggagtggaattgctgggtcctgtggtaaatttcactttttaaaaaactgccacactgttttccaatgcctcaccaccttatattctgtgggaaagtgacatttaagctgagacctagcagatgacaaggagccagccatgcagtgagtagaggagcgtcctggcatggcagatgggactggtgtcccctgtgaaggccctggggcctgagaaagagaaagcccacctggagagaggagctggatcccttggggtcgttggggaagattttgtatactgactcacctgcaaaagtacagaaaggagtctgtcggagagaacgaggtaagagcaggctgactgaggagggacaaatcctgaggtggctgcagtgatcctggcaaggtgacaagagcccagtggcggcagagggaggagaggttaggagggtggaggggccgcccggtaactggactgggaggggtgtgatggagtccagcatgtctccaggcatctgactggctgaacacacagcagaagaccaaagactggagacagcaagggggagtgagctttactggacacttgggtgtgaggggcctgtggagagcaccaactggcctcctggcagatttccagaagagaggatcctgcttctgggagacgtggactcgggtgtcctcgggagtgctccctcaggtgccttggcaccaacatgcctgctgccacagaccaagaaggggctgctctccttcctcatccatcttgttccaagcatgggaaaaagttttccctgattccccacctctctggaaagtcccaggtgtggcttcaacaagtccctgaagatttggggaataattctatcgcatgatcacagcaaaagatctcttccgaggccagctccccacggtactcctggccttgccctctgtttccctccaagtggccacaggcctctcacccctacctctccaaacctggggtctgggacaaagtgattcttgtacccagaaagcaaggattcctcttaccacagagtctgctagtgtctccaatatccactctcctctatgagcttttttttttttttttttttaagattttatttgagatagcaagagccagggagagggaaagagacaagcagaccccctggtgagaggaagcccagatgatgcagggctgggtcccaggatcccggatcgtgacctgagctgaaggcagacacttaaccgactgagccgaccgttcctcctccctgagctcctgattgagctaggcacattgccatccagcatagccttacttcctgttgcatatggtcatgtgattaagcctggctaatggggtataaggaaaagtgtcattttcaagcagggaggagacgtggccttcatcattcttctcaacagctggaatacagatgtaatatctggggctccagccgtgaccttggatcacgaggcggggtgaccctgggaatggaagccgcacgcaatggaacagtctggcatactctgcatggcttaactccaggtggcggcaccctttacattgtgttctatggcaaatagattacagaatataatgtgaagggcgtccctggagtttggagcctgggcccttgataccggagcaccacatcagcctcaaccgctaaaggattctgcacccaatttcaacatggggtgtgtgttttccccaacattgccaagcaattctccaacaccagcggggtggcctacccagcttaattctagaactgcctacctggagagatcatcagattccacaggtgaggggctcagtcccacaaaatttctcccacttcagatgccaatcacaagtccaggctattacctgttcttccaaccaattaaatcagagcttcacatgaccccctccttgggttgtattaagttgcttcggcaactcgtgaaactcggagaaacatttacttactagatcaccagtttactctaaaaggatacaactcaggaactggcagatggaagagatacacatgtcgaagtatgggaagggggcttcaagctgccataccctccaagtgcgccgttctcccagaagctccgcatagccagcaatctggaagctctctggaccccatccttttgtttgtttgtttgtttgtttgttttaagatttatttatttattcattcagagagagagagagaggcaggcagagacacaggcagagggagaagcaggccccatgcagggagccctatgcgggactggatcctgggactccagaatcacgccctgggctgcaggcggcgctaaaccgctgcgccacgggggttgcccccttttggggtttttatacagaggcttcatgacctagctggggttgattaaatccttggccatttggtgactgaaatccagctccctcctccccagggttcgggggtgggggatgggacagaaagttcaaccgttccatcacatggtaggttctccaggcaaccagcgcccaagctggggggatccaaaagtcacctcaattacctaacaaaagacactgtttggagcttcatgccaggaacagtggacaaagacaatatatatttcttattctaaattacaactacctacctccggacatcacgtaagagagaaacatacttccgtcatgaccacctgccatttgagaattttctgttatctgcagttggatctactcctaatcccatgtcctcctttcctctgcccagatccactgtgcctaggacaagtgactgtcggctcccctcggaggagagctcgccctaccctaacagtggccctacaacatgacccacagaaatgccaacagccaggattcctcaaagtccaggctattctaccttaggtctcatccaaattcatcttgggtttgattatcgattgccaattattccaaacagtagcttcctacatgatttctgtctcatgggttttctgggctcaccaggcatttctagcttagggtcccacatgaggttacaatcaggggatggttagggcaagagtcatctgtaggctcgactaggctggaacgctggcaggtggcgcgggctgggagctcagcaagggctgtgggttcctcgtggcgtggaggctggattccaaggagtgtcctggcactgaggcttccaatgccccagccttctaagccatgcagagtcacttctgccaccaaccgaggttcaagaataggggactagacaggatgtgaataccaggaggtggtgcactggagtccactctatcacacagctaagggtctggagcttggagagacaccagaccagacacaagacttcggcatcagcagcatttacatgctaattcaaagcccaggaatggatgggtgctgtgtgcacttgagtgtgcctgtggcctgtgtgggtgtgtgtgttgtgtgttgtgtgtatatatgtggggggggttaatgtggcatgtgctgtgtggtaggtgtagtgaggaggtggtgtatgtgcctgcacatggttgggagttggaggctggcagagaaaagatggaagtcaggggaggggtgtgtccttaaattagagtctttatggactggattcccttttctgctgcctcccactctcctccttcaaagctcctgcctccttcggacccaccccggccactgccaggcagggaagaagtttccagagatcactttgagggaggagcctggtccagggcccctggggcagcacatctggtcccatcgtgcccacgctcccacccaccccccactccctgagtacagcaggtacaggtgaaggccccgtggtgaggtgggcaggacttactgatgtccctaccttgccagcagctcccagagggcaccgttatcatacctctgccccatgccaggaggcctccagggaggtgtggggtgccacccacctgcccaggccctaaggtctgatacatgaaggtaacggaactgaaatcaggagtcctggactccacccctaccatgtgactgcaggtaggtcatttgcatcctttgagccaaataaaaaagactgaattaagatcaatttagattccatccggagtcccaggactgaacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgccactctcataggtgaggagagaggctgtgctgcgagtctcttgggacaagacaaggccatgtgcagccaggccatcagcgaccaggtccttgtctgagaccagatgcaactcagggcaggggccagagaagtcaccaggagacggcaaggggtgcaaaagaaatcccaggcaagccttgatcaaaggcccgggcagtgaccaagttaccagttacctcttccagtgcccacattaccgatggggaaactgaggctaggagtggtgaggggccaggccaacctctcaggcctaggcacgttgggctggagctgcatgtgagaatgtgcagagtgctggggtaggaggtattccttcccgaatcatccagtgtgtgtgctcacaggtgtgtgagaatgtatgcacctgcgcgggtgtgtgtgcagggtacacatgcctctgtgtgtgtatgtgtgtgtgtgtgcaggggtgtgcgcacgggtctgcaggcatgagggatgcgcgcatgccctgagcccatctcggggcctggcccacacaccatcccaggtccccaagggcatcagggtacactggccattggctccccaggaaagccatcgctcagaggaggggtcatttagcccgccggcactccgcttggttatttaagccaccaccgggacggggttaggaagctgagattaaccactggccctgtgactagaagcaatacatatttccctctcttttgccttttttgttcaccaaattgaatcaatttattgaagttgctcacaatcaacttatgctgattccccaacagtaaagaagagaaatgaggcgttggggccccagggccaaatttcactcattgaagtgaactccggctggccctagggggcgcagccagcctgtcacatgccattcccaccccacccactgagctgccccatctcccaagctggaggccactttggccaccctgctcccaagatggggcacacccacacccaggtgctcggctctccggcctcagacatctcaaattgaaaccaaatcctgaccccacctgcctctgcggagcatgtcacaccccttgtagctcagtgagccgtgctttctggggcagaaccccacaggatgtgggagcacagagtgtaatagatgcctcacccccaacatggtgccacagtgcttcagatgccaccatcagagctattgatcatcagggtaataatactggctgacatttgttgagaggttcccacctaccaggtgctatgaactcacctaatggtttgggcattacagttatccccatttcactgatggagacattgaggctgggacagttaagtgacctgcccaaggtttcaccagcagcaagtggttgcggcccacatagtgaatgagccatccaaaagctatcatcaagctcactttctccatttcagagtctgcctcatgggaacccagcccatgacatgagagctggaaagatctgagacgtgtgggccggagaggccccatcatccatgaacagagatgaggagcaagaacttggaacagtgagaggcagatgtgagaccacacagcccatgagcagtaagatgaagtctgtgtctgtgctgattcctgacattgcccaacccctgaggaagccctcgggttctgtgagacacccccggttctgcataatacaccctccctttgttgagctagcttgagtggatttctacttcttgccatcagagtgtcccggaataagacatgctgttattccgtgttttatgaataagaaacccaagtccagagcaaaggggccttccctgaggtcacagctggttagtgaaagagctggctcttcaccatttatttatgtaatgaatagctattgaggtcctactgtgtgccatgaattttgtcgatttgagggttataacttgttggggtttttttaaagattttatttatttatttgagagagagaaggagcaagagctggggggggggaagcagagggagacacacacacacacacacacacacacacacacacaccgctgagctggaagcctgactaggagttccatcccaggaccctgggatcatgacttaatccaaaggcagacgcttaaccaactgagccacccaggcacctctccggttataatttgtaagcaaggcaaacataatcccctttattgttgactcacaatcccgtgagagaaaaagacaagtaaagaaacaatgacaatgcaggatgacaaatgctatggaaccacttagggggtcacttaccctgggtgtggaacctcacagaaacttcctgggggtagtgacatttatgcctaggcctgcagaagagcagagccctataagaagatgggatagaatgccaaaggctcggaactgaaagggagttttggaatcagtctggttttatctgctcagcatcttctgggtggtcaggggaggtggaggcacagcttctctggctctgcgtcgcttctgggagatgcccaatcacatctctgtgtccctcaccatagggctaggtccatgacccagtctagtccaatcagcacctctctcaagaatctgcatctctaatggagacacaaggttggaaggtggtatgagctgaggtacctcgtggcggtacgccagagagaatacctatgctcctcagacccccagagctgccccagcttccatccatcccaagacccgtggtctagcttttccttctgctctgtgacctgctttgctgcctcttcaataaatcacctgctcttgtttctcattttcagaatcaacttttgatgcttgcaaccaaataatcctgattcagaaattagtaccaggagtgagattcatgaaaacccctggaggatgtatgagctacttagaattggttttcataactcaccaaggcccaaatcaggaagcctcgggttcaaattattggacagaaaagaggttaacccaggggacacagtggtgaacagctaatcatgttctaccctccagtcacccgggaccatgtaccaactgaacgtgagagaactggcagctgccatggccagtgcataaaggatgaggaatgctgaactcatacgctgggtgcttgtccctaacactggataatttaaagcaagaaaatgacaggttcaaatcaaaacatttgccccaaggcacagaataaaatttagggccattaagataactgtgctgaaggaatcttttattgaggatagccatggagttgaaattgcagaagactaacttacggattgattctgaagtcactgagtgacagttgaattcccaaccttaccagtccccctctgcaggagggcgggcatcggtcaggaagcactcaaatcctattggaatggtgatatctggaaggattatgaggacttggaggaccctaagcccccaggtggctcactgtccaacctgtgacttccctcgtgacatccttcagtttttcccagaatactggggatctgggctccctgtggtccagatgaaacaaagtagaatcagggggctggaaaagttatatccaaaatgatctgcaggaagtcactagtttgtgtttctaaggtatgagggatacatgtgggaatgaactttgagggtgcctccatcaagcggagcaggatggaagcgtggatttgactacatttatggagatgggtgtagtcaccagaaattccgcattcacgacgctcgggcaattggcacaagttctgacattttgcagaagtcactagtgcaaacctgggccaaacggtgatcctcatgaattgggtaaaaagatctgaaaaatccccggcataattagagggatggaggcaaaacaagacaagaatgctgtctagatctatcaatccccatcactgccgggatgctcccttcctgcttcccaggaggatactgccagtgagaggggatcataacctttcttttttaatcaaaatcagtaacatatttcagacaaaaggtataaagaataatgtaacaaacatccataaacctctttatccaacctaacacatgaaacatgtgaatttgagtcctccaggaaagtagacatgaggacgggacctggaaacatctgtgaaggagaatggggagggcaacggaggggtgggcagggccggcagggccagcaggtcacagcacagctggacgcctgggaagggcagtgcagagggagggaggctcactgggaagaatcccagacagcagcgcagttctgatatagttcatcaaggccagtgggaggtcctggagccaaagtcactcacaagaggcgcgagccctgcatgtggcacaggacagggtgtccctgccaggcatagttgggctgggtacagcctggggatgtgcggccttaacacaaatccagtggaggactcagcgcagtagcaagggccacgggtcattatgaatcatgcagtaggccctgtgcggcgttttcatggccacacatgaaacgtggccgataccaatcaaactccttatcaactgttaaccttccaagtctaaaatgggctcagctacctcctctctgtagttgaggaattctggcagaggggctgcttttgcaagggggtttctaatcttagagtgggtggaaggaaggagctctggtggcccagtccagtcaaatcatgggaaggtggtaggcatggtcatcccgaagaggcagagggcctctgggaggcagaggtacttgctcgagggtcccttgggaagggatgagcaaggagaccactggggccttcttcacctctgggtttgccaagtaatgggctcccttgggggtagggttcccaatccaggagtgggccagacccaggacctctcaaatgtaggggtgggcagtgcctctgagcaaggaccttatgagagcacgcagaaaacatgatgaatcttgcatccagcttccccccaaaggaaattactgccctttacctgcactgctgagcccagaatgaggggcagtaagatgaacatctggctaagtctcacctctggggacaggaataccacatggtctggagatcagagctgcccttttggagttcagggggcactgtgttccctgctgaattcaccctatgctaggtcattggggcctcaacccccttcacgggttatgtctccagttcccgagaggaaataaaggtcctgtgggtgacagtaaacccacaccagtgtcctgcacagaagactgggatctcataggaagagggcccaggaggaagccactgcactcccattacctacagacacagtgaacccaagcaacaccacgaccctgaggagacagcagagctaagtgccaccctcaaacactggaaagacagagctgtgatgatcctgatcacgccctcactagagtgaggccacccaccaccagccagtgcggaaacagctagatcacggcaaaccgcaacggctcacggtagttattcgggtggtgactccatttgcagctgctggttccagatgtggtctccttggtagagcaaattaatgtggccccagcacttggtattcagctgctgatttggaaaatggaacacactctgtctcggaaacagagacccccccaagagcagtctgcttgcccctgagcggggcagtaggagaatgtcactggcctgccccagggatgctggccttccagctcctccctggatgccctcccccttccgcggggcaccctctgcccaaggccttgtgctctgaatggagagcaacacactgatggcatccaacacgaaggaagtcacaggtgccctagacctctcggtaagatgcatgtgacagagacgggggcataattcagggcacgccaccacagtgaggatcctgcaggtccatggtctgggatatgctggaatatgctggaatactctcttcaaagtgaaggagaatttgctgcaacttgaaccccgctacctctgaaaaggagacacaatgcttggtggacttctttggatcttggaagcagccctgaggccaaatctgctgacacaacttgtaagcaggctggaaagcatccagctttgagtggggtcccgagcaagtggagcaagtggggtctcgagcagctttgagtggggtcccaagcaagtggggtcctctgcaggtggcctgggctgtggcacaagcctctgacctcggagcttgcccagcagcgctcagagtatccggggcagggcacggtgcctcgtggagcctgtggcaggcaaaacttctccagtggagtccgtagagcttctgaataagaaactattcttctttgaggaaatgggttcttgcctcgggctccagagagatgagaatacctaaccccgagtcactaagcagttgacagcctgaactctccatcttgaagcagatagcattgatgcctccagccctatgtggggtgtgcccagcagagctccatctccagtaaccccatgagtaaccctgtgtcagggcctctcctttttgtcccacatgggagtgaccctctatgctctcttaaaaagtaggactcacacaatttttaaaaatacaaagtacttagctgcttcaggtgaggctggatccagcagcccagtgatatcactaaagaccttatttctgccatgcctcttctgcctcctgtggtattgacctcatgctaacattaccctctcgggcccccacagaatggctgtcagcattttgcacactcccttcaagtctgctggcagagagcacagccctgctggccactcttaggaaagcagagagtctcctttcctggaatcccccagcatccttgtgtcaccttggcttaaattgggtcatgtatcccttgtagaccaattgctgtggctggggagcttcactgatttgttgcagacacctaggcccacccccactgcaccgcccacccagggggaggtggtctgaggggagccaatcctatccaagcagcatgaccaaaggtagagggggtggtcctctaaaggaagtaagaggcccttattgccatcaagtggggggaatggttgctgggcctcaacatgggggtggggtgaagagaggaatcaggtttgcccctctccacatgattatagaatcacagcccggtgttttggctggaatcttagaagctcagactccagccatgttcatgaggggggacccgtgttcatgtgtcctcagctagctgcttggaggggatggagctgtggttccccccacccccaccccggccggggagggcggaagggaaaacccacgtgcttcggacctagctctgtttctcctgaattcccagacggacccccctccactaccccgagggctggcttctcctctcaaatccccccagtctggtgggtgcctggggggcgtaggagccacctaccaataaggcggggtctctgggagccgagtcctgggaagatatagccctttgcctcaggttctacacttggagactgtgccctaatggctcttaaacagggtacacagcttttcagacaactcctcccttttgtcgtgataaaagcatttcacccccaaacccaataatcaaatcaactctaagaaagtgatagttagaaaaaaaaaaagtgatagttctgcatgctgttttcagacaaagacactgtcaccatctgtttagtcatccctgcagtcccgaggcagaggtcatcctatggaataatacatcagagtcaccggccatgtctacacagaccggaccggttcgttttgtgagcgtgcactgagcagagcagaggtgggaggtgccttcctccgcttctctggctgctgcccgcgctgccctgtccacttgtttgcaggtgctctggggcaagccttgactttggcctgaagttcacttcctctaactacttctcagtgcaagataaccacgagccccaaaaggcactgcctggaggtgggtcccgcccctgctgccttccttccctcccagcgggaaagagaagccttcgtcccagtacattttagttacagaccagtgtttaatttcaggtcgctgtttattccttccataaacatgtctccccatgtacaatcgctgtgtttttctgtctgtgagaaattgagtgtcttggtatgggatggaacacaggtaattttttcattaaaattaatgaaaacattttttcatctttatggctttgcagccgggggcagggcttttagaaattaattaaagtcaccgagtgagagataggtgtgtttgccctggagctttgcctcctccctgcacctctctcctgaccaaaaagaaaaacctccactgatgcttacgaggcctcttggagaggcaggggctgtccccagtggggcctccaggccccacattttctcctcctgtcaccagagtgttggtcgtcccccaccttcgtctccccctcacccctccaccgccaccccagaccccgcactccccggcctcaggagtagggaggtaggtgtgggccaacaaggttcagccaaatctagccagcactgggcagagtgggatgttctggacagttccacctttcaggggatccttccatctccctccaccagaggctctacccacggcctttcctgtctcccaggcaccgggaaccaggatcttcccagagtttccccatctcccccatcagggccatttggagcagtcctgcccagccccagcaccccacctggacattagagaccaaagagtctgtcccaaacacacctgtgctcagaacgaggcgctggcaggtaccaggaatgggtgggaagagggcagacctaggttgggagagagaacaagcgggtgctagctcgggagcaggtggcagcgggaagtggaggaagccagagcacaagggcgggccttcctgggcgggggtgctgggctgggaggggctggggggtgcccagagtggccaaggagacagagggctacaggggaggcaggcgcggatgtactgaatttgggatgtgtagcaggtggggtgggtatgaggctgtttaagcaggctcgtccggcgggaagctagggggagcgtgcagctctggagccccgagggaggtccaggcagaggtagagtggatctggggttcagcagtgaatcggatggaggatggagccagctgcccaggctcactggagaggccaggcccattctaaatactctaatatattcctttccttagcttattcctttagggcttaaatacatctccacctccagagctctttctatttaaatccaaagacccatggagaggtgacatcctaaacccttgtagtaatcaagctgtaagtcatagaaactgtattcattttgtttaaaagattttattttatttatttattcatgagagacacagaaatagagaggcagagacacagacagagggagaccgggagcccgatgcaggactggattccaggactctgggatcacgacctgagccgaaggcagacgctaaaccaccgaaccacccaggtgtgtcccaaaaacttttagctcaagcaaaataaaaagggaggaggtggatttatttccttaaaccaatataaagtctggaatttcaggtacagctggatccagatgctcaagcaatgtcatcaggattgtcttgactcctgtgagctggcttcactcgcgggcaggcagggaaggctggcagcccagcttttccttctactagagggaaaacccccacgggaagggaaaatgtcttcaaagccctggtatcgatgggtttggtgaggctggggtcatgtggccgcctgagccaggagtggggtccattcaatccacacagactaaaaggagggagatccccaagtaaaaggtagaaattggcagctggagctgaggctggaagcaaggcccttaccctagcacataagttctcagagggcaggaactttgtgtctgctgtgtcttcctggcctagaacacattgttggatggatgaatgaatgaatgaatgaatcaatcaatcagtcagtcaatcaatcaaccaagctaagctatcagacaaggtctggaaacctggtctggaaacctgggaaaaaacagattttccttgaggccagcctctgtggggcacttagtgtgaagaataaagaaggcaaagatgtggcctgttggggggttgaggagccactgaagataagcttagctttgaggtcagccaggtcgtgagaggagaaggtgggatgtggggcctctgtgggcaaggtaggaggggggtgactagcccagggccttcaggcccaggatcagagtcccattgagtcctctatgttccctgcagtgacatgtagactccttctctaactcgccaagaggctccttaagctcctttgcacccccagcacctgccgggtgccgagtactttggaaatactgaccactcaaaagaaagacaggtggtggccctgtcctcaccagaagttgcccccctggagctgaacacagagatatggagacagagcccatgaagcctggaggcttccctctggccggttggctcttgggctcagcaggccttcctggctcaggctgtcccatccccactccccgctgccctggaccaggggatgccatggcagacagactagcactgcctctctctcgggttatgtccacagagaggctagacaaggacacactcccagcctgtgtccccctggggactcaggaacagtggaaagagagaatgcactgaatgcaggagctgacccctggggaaaaatctgctactgatgccccaatatctctttaccccgtcttctagttggccatatggagtgtcaggatgttttccttgcagctaggaggggtcatctgactaagttctggccaatgggacatatgtggagcttccaggaattttgcttaaagacagttggcatatacacactttgcctcttcttcttcatcccttcttttctgatgatggaatgaagatgagatggctagagctgtggcaactatgttgggtcatgaggtgaccctagagcggagaccatagatagcaaagcaataagaaagagctcaggtctccaaggactgtagagcagaactgccatgtcatccttagacttttccatgagagagaaatgcacatttatattatataatttattgatattctgtccctattactccctgtcaaacctaatcctattgaattcatgcttcagtcctatgactctcctagtgggcccagtatgaaagcctggggggcagtgggtgctggggctacactgagctccaggacctgaggtcattcctcaaagacacagcttccccacctcaccatcccctaactactgattctcacctcctcccacatatacatgcccacatcaggatcccatagccagagcagacctcagggagcaccttgtgccacctcacccccttggcaaataggtactgtgcacgactccatgtaggtcttgggggtagatagccaacatggcatggctcctctggaagttctgtatcgggggggtgatggcaggcacagagtgccaagatggggcggatgcacggtttctaaagagaggtttctaaagagagggctgtctaactatggacagccctgaagttcggtcacgtgtttatcagaggttcccaggacacatgagccctagatgtgcagagctgccccccaccatcggccagcccaccctgctttcaggcagagaggcgcatcggaggaatacagctcgcttcatcctttgtccttactcccagttgcctgcccggcccggcccagggacaggtacacagtgctgcccctgccttgctgggccacagcaggttacctgaggagctggagccagcgaggaagaccactgggcctcgtggaagccgtgccattcgggagaagggcctgtccaggcccctaggcccaagggtcagggttgactcctgctctgatcaggtaccagagtatcaggcatgagctgtagaactgtccctgtcagctcctccgtggtgccagatcctggccagggacatggggataagtaaagccctgtccctgtcctcaggagctcacagcccagaggagaaactggacctgtagacaactgcagatggaggcacttcctagtacaagaatggtcacatcgactgttaggcctctgcttgttgccggccccccatcagctcagtgagtctctcagcgtctcacggaggccccatccccagggagaccccagggctggcccatataggctgcaggcagcatcttctcaagtcctggcaacttgggaccgtgttttctatgtgcacactgtagtggcatcaacaagacacacgtgtcccccgggtaaaggtgcagaacggtccctctctgacctggcttcttccacatgcagatactctcatgtccctcactgaagcagctccttcactatctggcacgacggctgaacaagggcaggccctgtcctgtttccactgtggtccctactgcccccttgcctccctcccccatgaaaagagactaaacagagcctcgaggggtgtatgggaggcgtttgggcagaggggagcagcacagagcagttgatctgtaagcaaggccccggggtactgagggtcctgtgcctggagcacagggtacgttagaggaggctgcgggaggagccgggccctgggggggcggggtggcaggcagagagcagaccctgctcagatatcgccagggcttaaatgtgagcccaagaccctggtaatgcggaaccactgcctgctattcagaacagtgtgtgtgggcctcacactggcccagagcctcccactgcagcccctcccacccaggcagcaccccctgctccagcccccacctgttacaaagctgtccttgctgccctagcccagtggtagagacctggtaaccacaggagtgtgggtgtaacagagcttcccctaaggacaaagataggagctccagaggctctagcaggtggagcagagcacacatgtgcacttgtgtatgcgcctgcaggagggtgtgaggccatatgaactatcggcccttgtgccccaagaacagagtccctggccctctggcctcccacagcaccccacagcgacctctgtccttgtcctaacgttactttttggtctgatctcatctggtctgcaatttccaccagggcaatgacagaatactatggtatctcagggagtgcagcacctggcatatagtaggtgctcaagaaatgcccagtgactgaatgcatgtgctctgggacagcacaggaggtgtctgtgggtctgtgtacacctgtgggggggcacgtgggggggcacgtgggtgtgcacgcgggtgtgcagtgcccaatgtggccaggtctgcatctcacctcacccacagaactttctggcagggccaggaggaggggctggttttctttcccactccatttgtgtgacaggtgttggcagtttatctaactgtgataataaagaggatggggggggtgctaattccttctcactttattgaatccaccaatccttcacagcctcagggccctgagagggggtgattaaaagacacttcagcgcactgcttattgccaattaacagacttcaatataaacaattaataaagccaccatgggaggcgagaggaagggattcaatgccccagcctgggcaagctccacctattcccgaataccctctctccccgcaggctctaccactcagagggctctgccctgggagtaggtggttaggggtaaacacctgggaagggtagggggatgcgagggcgggtgctgctggcagggtctccccagtctcaaaactggagggggggaggctgcaagttcaccccagtgataccaatagaccccagtcccagaaaggacaggggctcacccaaaatcccagccacccctcagtgctctttaaaccacacccttcttcccctgcctgcccccttggccaggtggtggcccaccctgatgggtctcctttcctatccaaggccagttattgaacctctgaggagaagccagttgactgcccctgcttatcaggctggcaccgccatggtcccaccatggcctctggtagccactctctagtataaaatgggccccccctagctctatttttttaaagattttatttatttatttgaaggagagaaggaggggaggggtagaaggagaagcaagactccccagggaacctgatgtggggctccatcccagaaccctaggatcatgacctgagccgtaggcagacacctaatccactgagccacctgggcgtcctgcacacttagcctcttcaggacaactttcaggggttgctttgtgagcttctgctctgtgcccccttagtgccagatgacacccaaacccatctcatgaaatcctcaaacagaccttagctggaggtatggattacatgggaaaacacatgcctccaagggtgagggagcttggttacgtgacccaagcactctgtcagccagcaggtggggggcaggggcaggggcctggacgtgaccccaggttcaggctccacaggccacaggctctaggccaggggtctgcagacttgctctgtagagggccagatataaatatttcaggttcacagaccacataccgtctgtcacagccacccagctctgcagacgtggtacaaaagctgccataaacaatatgtaaacaaaggaacatggctgtgtgccaacaaaactttatttatggacagtgaaattttaattccatgtaattttcacaccacaatatattttctttattttgattctttttcacatatttaaatatgtaaaaaccattcttagctcacagaccgtccaaaaacaggtggtgagccagactgggcctacaggccatgttggccaacccctgatctaggctttaggaaccttccagattccctgagtatcccaaagggcatgttcctgggatatgatccctcctggggcagggagtttgaagtcccacgatacggtcttattggcggagagctgggagggcaaaaaatgaggtgccagaccctgtttcaccagagaaccacatgcatggtcacaagcatggccacaatgagggacagagacgggctgataggcaggatgtgatgcagaggcagacagaggaaggggtgtaagtgtagagagacagacaaggagtggtaccaccagttcttctgccatccagctgacttcagggcaaggcatggacaatccacaatggtggtcaagcttcagcactgatgttctgggacttcaaggtaaacgagagagaacagactcagaaggggctgagaaggtggctttctctcctcatcattcacctcattcattccatcaacaagcatgttctgagcatctactaagagtgccttgtttttcagtttgggacaaagccttgcagctgtctttggaaatgaccctggcgggtgtgtgtgtgtgtgtgtgtgtgtgtgtgtgtgtgtgtgtgtgtttgaggacgtttctgagctgcctggaaaataagagtaaatagaggacatccgtgtcaacagagcagataagtaatctcttgaagaaatccctgggtgttggcaaagcaagtaatttagcaaagccagtactaggtagaggaagcaggaaggtgtcctcaaagacttctgtaaaaggcaatactgattgatgggagagggagaacattagctttggaacagcgaagtgagtttgcaatctggcccctggcaggggctccccccttgtccctgcctcctgcctcagcttccacaggaggctttgaggggcaggggacaggtggtgggaccggagctccaacaccgcatctttgcagctgggtgaaacaacccaagcctcggctgtcccgccagccctccgggtggggtcagggagtaagacccaagtgcctctcctctcactctgatctgcaatcctcagaactgccagctctgcctgaaaagtgtgcccccaaatccaaccactcctcccaccctatggctgccacacaggactggaggctggaggaatgcaataggttgcatgcagccagagcgcccctgtgagagcattggtcagactgcctgcctccatggtctcacagccctgccattcctagggtgaatccacatttttagcatggctcaaaataccacaacctcatgtccgctgctctctacacactcaggcacccccaacctcactggcctcctccctgttccctctgatccctcttcccccagatgcccccaggcaccccccctcacttccagcaggggtccccctggctccctccctgacctcttcctcactgattttccctgcttttcaccccctggctagtctccctttgcccccagcaactcgagagggcctcaggtctagggattaacatggctccctgaggattcagggggtcagtgaaggtgaatgggaaaaaaaaatcacgtctttattttactcattttgggctgaaatttaacacttgcttccattgtgtctgttagcaacagaccatagcagttgtcacgaaaccctgtggctctgtcacacatagaaagcacagataatttcaaatcgtattataattgcagaaccagttttgaaataccatttatgctcaaccctacttcaaagtgatggtagttttattaggcccactgctcaattgtattatttagtgcattaataaagaagctcatgtattactccatcccaatttcttaatattttgataactgcattttatataatcagtgtcctctgaatcctataacttttattgtgtggacgtataaatgttattctgaaaagaggtccttaggcttcttcagatgccagagagtccacagcgtagtgacagtgaagggccaccgttctagaaggtaaactctgtgcagagagggcccaacgcaaagcaagatatatggatggaaggaagaaagtgcggaggaagaagggagggaaggaggaagggtgagagggaaggagggagtgaatacagcacgaaagtgaatatagcttaggggcaggagcagggcctgagtcaaagtgccctgggtgagccctgctcactagcatgctcagcacagagacttggtttgtcatgaaccggccagagcctcgatttcttcatctgtaagatgcacagtcatacctgcttcatagggtcattgtggagataaaatagtgtgcttggtacatggcctggcacatggtaaatgctcagtaaattataacatattttagtcaatgttgtggcttccctagttctaggcttttgcctgagggtctggctcctcagccaggaaggcaaaggcattccacagagctctcccctccaccctgcagatgtctgagagcgggccagggctgggccatgggcagggtgtccattgagggtgggctgggggtcgtgcctacacgggtactcttgtctgggggagtggggtggaattctaatcatgcccctagaaggggaaatcctccaaaaccccaactggtgagtctggaggcaattatgagagcagccaagccaggaaggcatctggggcaaaccagtaggacaggggctcctgagctccctccttgctgccctgcagcctgggtttccattttacactacaactgctgtctgagaggacaaaatccttgcccttcctgctcagggaagcctggattggtctctcagctcccttgcccgaggccctgcttcctgaccttctgcccattataacacacacaggaaacgatgaccatgggcagaggctccaacgtggagccacatgtttgactctggacttgttaatcctcacacatctaggaataggcgcagctgtcccatgcagagaggaggaagccagcgccgggaggagtgaaggctggtgttcgtgatgtggaagtctgtgctccctcccgaagcacgaagcacgcctggcagagaaggggaggcgaggacagagaggagggcgtgaagaggaaagagagtgccgtcttgaagaaacttgaagtctggagagtcgggcacaccggaggggaggcagactggggtgccgattcgggagacagagctctagccaggaaaagcaagctggcagccactccggagcaacccaggaagcctcagctgggccgaggaagaaggtaactgccagcacatgcacatctgcactctggagagcccaagaggcactcaaagccggagtgaggaggaggctcctagggacaccggggagatgcagagtcatgaaccccactactcaccatccttgctccgccagggatctcagcccatcctgactcacaccattctcccctgagtccagagttaagacccagggataatcggatgcattagagtaggtgtgagggtagacaggtaggtgtaagtctctgagggttggttccctgatgttgggtagctggagagcacaaggcaagagggtgccttgtcacttttggtggctgggtgtgcgtgtgtatgtgtgcaccaagtgtgtggttctgtgcatgtcttcgtgcacgggccccctcctgtgtttgcatgtacatgtgcatgtgctatgcgcatgagcaagtattgagtgtggacagtcgtgcaagtgtgcatgtacacgcggtggcaggaggggtgtgggcgtgtgtgctgtgtcaatgcacgcgtacgcacgcatgtgtgcccgtgctaaagagctccgcagagagtactcacggaatggggagaggatccccgctttcccatcatcccccactgaagctggctgaggaggctgagcggggaagggaggcctgggaagccatctcccaaaggtgccaccatcagcaggggagggagggagagagggaggaagcagcaccttatttaaatgcaaatgactgaaatacaactttctgtattaacatgcaaattgcacttcagtctcacacctcccagtgccaaagccacggaacactttcaggaatcaaagctgcaggacccccaatcacctgggatggtgagaggccccacttggtggatctaggaagaaacaggggacagaagatgggccctgggtgggcttgagatgctgagccagatgttcatcctgcctccagggcttcagggcgaggccagaagtggggggccggaggtctggattgctgcccccatagtagaccaggctggagcttgctgtgggtcgtccactggctctctgcctggctggggcaacatgctttgtggtttcctaatgagccgggctccggtgagcctggagccctcctttgggagatggtaagaatcgtttgtctacttgccaacccggttcaacagatcatgtcttggatggttgaatccggctgcagggagcagagcgtcgcggcccacccagagccgcctccagccctgagctcaggccccaaggcgggcttgactctctctttggccctggagcaggctgccggcacagctgtccgggtcaccaggggggctgcgatagggcccgctccccgagctgggtcacctggcaccagatcctctgggaagaagggcgtcttcctcttcacacgcagacgcgctggacttacaccctctcctaatccaatcctcccacagagggcgccttttcctaatttgcacacagtcgcggtacaggtgtgggttggggggtgccccgagacctcggccttctctccagcccttctacacctgcctctctggtcttcccttccctccctgctccttggtttcccaccacccccatgtctccactcggttccctgcaccccctccttgctctgcgtcttccagacattacccaccacctctcgtaccctctctccataccctctctccgtgggtctcttttgtttgtcccctgccctccctcatcccccccccctccccgggaatcagcgtgacctggagtccttacctgctggggcctgggcaggtgcaggcagccgagggagggcgggccaggccctggctggctcagggccctcctggcacgtgcagggagcccagggcgtgggggagggtcccggctgcttccatctgccaagctccgcatttaggcagtggcagccggggcgctgcgggggaagcagaagacatcttggagctgcagggggagagggctgcatttcatccacataaataggcccgtctgtctccctgggggcgggcgactttctgggacacttctgatgtcctgggcttcccaggagagctccaccggtggagcagggggcctgtgatgaaaccctccaccccaaccccccacccccaccccaccccaccccaccccaggccacgtgcctcggggccaatgccttgggcagtcctggcctctttcaagcatccccttggttgtcagagacccagcaccacaggccccgtgggtcacggcgtgagcccctcttccttgatgtcacccccaaattactcccccctgatctcaccaagcccagggctcaggaaggctgctcttgggggactttgaggacacttgctgcctcatggagatccccacctctctgtgagctggggccaggcacaagaaatgacaaaaaattttagcgagagacacagatggctcctggctcttgccatgctggcctcaccctcctcggcatggctctgcctggacccggctctgtccactcggggggcggggggaagaccctcatgcataccacgccacgccaccccccttttgccaagctgctgtctactatttcttttttttttttttcctgtctactatttctgagtgtcagtgcgggcttcgtcagaccctgctaccctgtcaacacggcagaggaaggagaccacctgggagctcccagagaacagggactgctcctcccatcaagctcgtggaggttccctgcctctgtcctgagagtggagttgccttcatagaaggtggtcctgctggcccgctgatggtgtcccttgggattctgtctcaagagcctgatctgtccttgagagtccggggcttggaggggacaggacgcctggatggctcagtggttgagtgtctgccttcagctcagggagtgatcctggggtcctgggatcgagttcacatcgggctcccagcagagagcctgcttctccctctgcctgtgtctctgcctctctctcgttctctctcggtgcctctcgtgaataaataaataaaagaaagaaagaaagaaagaaagaaagaaagaaagaaagaaagaaagaaagaaagaaagaaagaaagagaaagaaagaaagaaagaaagaaagaaagaaagaaagaaagaaagaaagaaagaagaaagaaagaaaaaagaaagaaagaaagaaaaaagaagaaagaagaaagagaaaaaaaagaagagaaaaagaaagaaagaaagaagaaagaagaaagagaaaaaagaagaagaaagaaagagagaaagaaagaaagaaagaaagaaagaaagaaagaaagaaagaaagaaagaaagaaaaaaagaaagaaagaaagaagagaaaggctctggggggcccttgagggctctgggggctggtggtgttcacccagaccctgagacctcaggcctagaatgttcttaggagggttttgcttaggagagaggcactgggaggccagagcctgttccccacccccacttccagccactggcgtcagtcgggtgtgaagggaagaccagccaggcagtgaccgggggccctccctcaccctggggaaataggttcaaacatccacagaggaggaggcgggaagtcttgggacaagctgacaagaggctgaggatccctctgtgcccggtgggtgtggaacagtgtggatcatgtaggacagagagcttgggctctggagccactggactttgcactcactagctctgtgatgatggaaaaggcacttaacccctctgagcctctcttcctctgaggggactcataagaggacctgcatcatggggatgacatcatacagcaaggactgtccctaggcagaagcccctggggctcctctttggatgattcttgggctggaagaggccccgctggcctcgtagggtgctcctgctaagcagcgagaaggtgctttgctatgggttgaccgtaccccccaggccctttccactctgcacctgcccactccgtgtcaagccagggacctctgagcactattgacagggcagcgccatcctcctacttggccgccctgctcagcccggccagccaggactagaagcccccggtggggcaactgcgggcttgctcagcacctctcccagaggcccctagagggctcaagccctgacggcccacggcaccacctgccagcctcccagcctcccagcctctcctgggatcccctctcaactaaaattgagcgtaattggatttgaattcttatctcagggtctgcctctgggggagcccaaactaagagtttcacatggttgtgagccagctctccctacaaccaagtgactcagaggctggaactgggacagagagctcctccttcaggggctctgaggggcccgagggggggggggctttaaggagatgctttgtgaccaggctctgcagattcctgctgcctttggtgctgcgtcaagagctatcttctctcatgttctcgcttcacatgtcaacattcttttatcagcccttgtaaaggaggctgccagcagcatgcggtagcagcgaagtcatgctcagttcttgaggaggtagagtcagaaaactggaggattactaacatacattaggtgtgatgtcttattactctcatgacaaccccggaagcaaggctgccacatacagttgggcaggttgttcactgcacaagagcatctggccaagaggagagcagatgctcttcctatcaagcagcatacctggcccatatctgtgacccttcgggtggtgaggggaagaagaggaaagcttttcataatttggaaactgaggcacagagcccttaagtaatttgcccaagattctcagcatgtaagaggcctagttaactaaaactctaattccaggaattctgacttcagagccttcactccttactatactacttcacacagccttggcaggctgagccagtaggacagctggaaagttggggggaggggtttgactcttgggggccaagtcagtcctgagacatggggtctccaaagaaccaaggaaagacagtcctctcccctcagctgaccagggctctgggggccgagcctgagctccctgccacgagggatgaggccatagcgaaaagcaaggagactggacttctgtggctttgtgatcctgagcaagtcacctcacctcacacagcctcaattttctcactgtaaaatggagtctagatgttccatcctgcctgtcttgctggctaggattaagccagatgtttgaaggatttcagagggaaggaggtatcctccatgcctaaaatcacaccgagaattgcctaagttaaagctcaatacatatttgccatctgcttaatacaaccatttttcccgggtctgtctgtggggacccccccagtccctgcacgcactgcctgagagcccgtcgttccacggctgccttctccgacacggagtagcagagcctgaatgccagggtgctcctggctaatgactcagcctccgtaacgagtccaaacatctggctgacaaagggcacggctggctcccaaagcgactgcttctgcacaaatatgttcttaatattcaattagtatttatccaccacgaacaacaattatgccactgactctcaatgaagtgcctggttaattaattaacggcgtctttaacgtgctggcagtatttctctgtgagtgcaacagttaatagcgcagtgacgccaggaggacctggggggctggcggggggcgccctgggttccccgggccccagatgtgaatctggagttgagcatgtgtcacacaagccatcttctggtgttaacacacacacacacacacacacatacacacacacacactgggatgtgcagcaagccacttaagcccttcccacccagcctgtctcttcagtagcaggtgggccagggggtcaccaaggctccctggagtcctgaacgcatgggtcccgtctgtgctgctcagatctgcattgatccgcatatctccatctccacacacaaggaccgcttcagtccactcggccccacctcagaggccggggggggtgggggggggggggctgctaaccacaccccttgcacctctttcccctccacccatcccctgcccatgctccctccgtgcgtgttccccagagctatgtcccccttctgcttctgtttctgtcctctggtttctcccagcctcctggtccagcccctccgctagccgtctccaggtccctactgcctcctctctggccccaccttcctcagagtctactgagggcacagagtgtgcagaccgagctgcctgaattcatcctggcactccacttactagctgtgtgaccccaagcctccgtgcctcagtttccctacttccagaaagcagatactcacgtgggaatgaccatagcctccactgcattagtcgggggtgggactaaactgccataatcgacccaaaatgtaatgggtcaaactccacagctgctccagcatgcgggatgtgttcttaaactaacagctctcatgttggccttgggatcccccacctgccccgtcatgcagaggcgccgctctcctgggccagttctgcggtgagtgtgggtgtcattcccaccagctcttccaaagacagggtcagcacctgaaggcccgagataggggagccagcaggggggcttcgggagtggtctaggcaagagatagctaacagcttgaaccagggctgtggcacaggctgcagatttgacaatagatttggaagacaattctgaagagtccacttggctcactgatctcctggtggtagatgaggcgattaaaaatgaccctaaatatcctagtctgcatggctgggagaagacggagcaagccactggtcaagatagggaagaaggaaggaagagcaggaatagggaggaaggtaaagattttgagttggcccactggcttgaggacctgggggggcattcagatggaggtgtcaccagtaggcaggtgcagactggagtctggagtgtaggggggaagactgggaggtgctggcccagaggtggggattccagccttggggtggggagtgggagatggatgggaggctgtaggctgagggaagaaggaggtcccaggataaactctgacaaaccctgacatttaaggggcagatggtgggaaagcaactcaaggagaggtctgagaagacaggaagggaatgggatgtcacctcacagtgatagcagcagggtcatggaaagccaccagcagtgttagactgggtcagatggtgttagacgcctctaggaagtcaaggaagtcacaggcaccgggacaaaccttcccatcctattaagaggctacttgtagccagcagcctcctgcatacaaggcttcaggggaagcgaaatgttaccattatctcagtttcctcaagggtttacttacaaattaggctcttcggtgggcttcttgagaaaattgtcaatataagatagagagcagaggccatttgagggacggaggagcgggtgggagtcctggattggagagaaagctgctctttctccaagtgtgcagggtatggggaaggggagagagtaggaacgggaggcagggccaaaagccaggcaccgctttctcctggtggggaggaggatgagagaagaactagagaccaggaggagggggagactgaggaggtactccctcccctccactcctaccatcacccagactggggacaaccacgctggccagtctccctctcccagtgcaccctggaggcaaatcagagtgagctcaagcccaccacaccacacctctccctgactccgaatcactcactggctctccatggcccaaaacaaggcccctggctccttgcactcccccactcagagcccaccccaatctccccactgcctaacttcccaaccatttgccctgctccttcctaactgaaaagcacactgctgcagccaaaccactctggcttgatttcctccagaaaggccagtccctcatgcctgtgaagaagctatttttgactcctgaacacttgtttgagttcccctgatagttttagaaatgtggggaagcaaaaaggtttgaccctttgagaagccaaacagttacacccacccaacaactatagggcacccaccttctgctgagggggctcagggaaggaaccctcttctcctgaagccaaaaccaatcacagctagcccattgcttcccttcgattaaaaggtgagcatgtgacccagtttaggccaataagtcatgaaaagaagtttgtggagggattctgggaaaggtttggctccctgatgaaaagaaagccctgtgctagaagaggaactctgcttttctgcttttggatagagagttgtgagcatgtgatgtggcagccactttgtgaccgtgaggggaaacagctgacacacagagagtagctgaatggaacaatgagcagaaatgagggccaagataatgtgctgagccactgtactaccctggatctgctcaacctcctgatatcttgttaagcaagctactttggcctcctttgtcaaattcagaagaaagagaaggagaagacccatctcatagggttgctatgcagagaaaagcaaacccttagctatacatgcctgcaaatacacctggaaatatcggtgttaaataaataaaaatagtaaaaaaaaatgagcccctttgaattggcttttctgacacttggatggtgaagaatgagctccttcaacagaaggcaggagctaaaaagctgacacagaggaacctatatggggtggagggtaaatgtgcagacttggaaggatctggagcctcagagcctctggcttatctaggggaatggctggcatctgtgtggtctggtggggggcacaccccctcatctctagcagtgccatcaccccacacacactatcttggctcaaagggccaaatgtaagtccgttacagagggaatcaagtgtgaacagggagcagagcaggatgtcctgtcgccgaagagcacctggaggtgaggctctgtgcaccgcaactccccttggggactatctaagggccagttctataactagacatgccctccccaatcgtgctgtgaagatccacacctatcccctggtaaaactgtagtgttggtggttgaagtgttgagcacttcagtgtcttgataccagctgtctgaaggccaggtggcatccctgactctcctagactttgagtctcctgccctgattctgtgagccaaagcttacccttcccaggctggcttcacagccctgtgacctgggcagtgtcccaggccccacacccagcctaatgtcctgctgttgctgccttgaaattactgattttccaacaagggaccccatcaggtcctataaataatggagccagccctgcccttcatccaggctgcctgcactggggtttctgttcttgccaccacggacccagtgcacagacgtccttcccctggttccagcaggtgctgccctcagtcgtggccacctgaacacctcccctcccccgccctggcacagcctcgcaagcacccctccccaccgccacctcctgggttcagattcccgtcctggcctggagcactggctgtaatcgtccctaaccagtatcctggcttcaggcctcttccccttctgcgcagcagccaccaagatctttctaaattacaaatcggatcatgtccctcacctgcttatagcatctcaggggctcccagcagcttaagctataaattccaagcccctgtggcctaaggcacaaagcatttcctggtccagcccctgactctgtatcgagaaatcatcccaagccatgcgctcccggctcccgcaagcctccctccacccgtactcgcagcatctcttttgatgcccagaaggggcccttcgtgcctgtgtctctgcacacgctgtttctgctgctgagcgctctgtctccagttctgcatccagctaactcctgacaccttcagaactcaagtgccacctcctccagaaagcctccccctgtgcccacagcccggagggcctctccgcatggtggccttaatgatccacttgtctcctccccgtgtccttggcatccagcacaaaacctctgggtgcagcggtggggggtgtggcgcgagggagggctaacccccggggcaccaaaagccactcctcctctctgggcctcagtcctcctgttccttccttcagcaacatgccctgagcactctctgtgccaggcgctgagcaggcacctgccctgcagccaacatccaaccagacccaaaccccagcctcagggagggagatgggcaggaggggtgacaagcatgaatgatgcacagtgaatgaacacccatgacaacatcccctggaagcatgcagagaagacagtccatggcaggtcagagagggatgggggtgctgcctcatagcggtgcccaggaaggcctctctagcaaggagactctcctgaagcaagtgaggggcgtagggggggttccaaatagaaggccagggagggcaaagggtgagtcccagcagtgtggccagggcagcacgagtgagggggaggatggaagatggatgaggtcaaggaggaacatgggggtgggtcaggggtcggataggctgtagcggaaaccccgcccaagtccccccaccctcgctttgccctgaagcccacctcccactcccatccacctactctggcttctctctctctccttcaatgaacagcttcatccttccaggcctcctgccccttaccccttggcttttccatcacccccagaccccctcaacacagcatctccttccttccccctggggcaacccccagtgatcccctcacctccctgcctgttgactgaccccctccatccctgtaatgatggtttgagcaccctgctccatcccccaccggccctcctgggattctagctgcagccagctccacactgaagcatcccactggagcccatccgctctctgggccagggggcaggggtgggactcaggcagcccacagacatagcgtccgaaggggtggaggtcaataccccagaggcaaccttgttcatgggagatgggggtagagggataactgtccctgcgagagacagtactgagatacattctacgtgttcctctggggttcccgaaggagctacctcccattgcccacagccagtgaccagctcaataatcctgtcccaccttagctctcactccttccactccctcattcttatttatttcctgggatcgcctcacagacaaactagtctccaagctaaacttggagtttaacttgtaccaagtcttgtctcgggctctgctttcatggaacacaaatgaagccagtttttgtggttacgtaatggagaaggggtccttcctcccggccaagggcacacgtgccaccagccacccatgcagtataatttctccccttttctggagactctccacaatccagctgccagtcgctcccctacgttcacttattctctctctcccatcatttatgtttaaatacagccgagtttcctgtccaaaggaaaaatgaaacattcttcaaccccatttccctctggcttctaaggactcatcttgctccacctctcaggtgggtttggcaccactgctcactccctacaccttgagacacactctctgctggcttccctccttcagatacctcttctcagcctcctctgccaggtcctgctcctagaggagaggtcctggtcctcctatcctcacactgtgctgtctggaggaccccgcaaacatctgcacctgtgtgtgtccagcccagactgctctctcaggcacacacccagagatagccaagcacctgccttttgcccccactatcatgtctcaaaggtacaaaaaatcagtacatcccaaactgcccactgtatctcaacccactccttctaggttccccatcttagcgagggtgctagtctccatccaatgatgcacagatcacatgctgccctggagccatcgtgactccattctctctctcaatcaggtcccattcattaccacatcctctagatttcacctcctaaatctttatggatcagtctacttgcatgtgtttcatcactaccacccttcatcctgagcaccttcactaaaaataacatcctaaccaaggttaccagataaaaatgcaggatgcccaataaaatttgaatttcatattttttaaaaaatatttttaaagtataaatatttcccaatattgcatgggacatacttacaatgaacaatttttcattgcttatttgaaattcaaatgtatttttaaatgttcttttttagttaacattctatgaaattctcatagtatttcaaggatcatcttgtatttttatttgctaaatctggcaatcctaatcttcactgatctccctgtaaccccacactgtggccagatgaccttgttcaaacaaaatttgctgagtagtcaaaatgttaagtatatgtatgtaattgctagatccaccactttaaaaatatatatatgtggtatgcctgggtggctccgtggttgaggtctgcctttggcttgggtcattatcctggggtcctgggatcaagtcccacagtggactccttacagggagcctgcttctccctctgcctacatttctgcctgtctctctgtgtctctcatgagtaaataaataaagtctaaaaatatatatatgtaatgtacagcatagtgactatagttaataatactggattgtatatttgaaggttactagagagtacattttaaaaattctcatcacaagaaaaaatttgtagggatccctgggtggctcaggcactggtttagtgcctgccttcagcccagcgtgtgatcctggagtccagggatcaagtcccacatcaggctccctgaatggagcctgcttctccctcttcctgtgtctctgcctctctctctttctctctctgtctgtcatgaataaataaatacaatctttaaaaaaaaaaaaacaagaaaaaattcgtgagtatgcatggtgactatgcatggtgacggatgttaactagatttattgtggtgatcacttcccaatatatacaaatattgaatcaatatgttgtacacctgatactaatattacatataaatcatatttccatttttaaaaataataattaaaataaaattttctttttgagaaaaaaatctaagtacaggaaattctgttaaagaagaaaatgttattaatggcaacaacttaaattagttaatattatattgagtgggggatccctgggtggctcagcagtttagcgcctgcctttggcccagggtgtgatcctggagtcccaggatcgagtcccatatgaggctccctgcatggagcctacttctccctctgtctttgcctctgcctctctctctctgtgtctctcatgaataaataaataaaatcaatataatatatattatattgagtgcccattgtgtgccagaaatgcctggaaaatgttctgtttaaccaaatagtctgattagtcaaattatcatatataatatatatctacttgacatcactatttgcaaggatataacaatataagcagcactaagattgaattcagcacatgagaccatatgatgtttcagagttaccaccataaaatattttaggagcacataaacattagcatagaatctggaaagtacatatgactgaatgccaaggacacaagagtcaggtcctggtctcattcttaccttgttgttggatttgagcaaatcattttacttctctctgttgcagtttcctcctctatgaaatgaggggctacactaaatgaactctaaaagctcttctggctctgattcaatcaccttatagtgtgatagattgaagaagtgctgcctcatggtgtttctgttgagaaaatgctgaatatactagtttctactatagttctataaaaatgaaaaacctgtaacttcgtatctttgagggaaaaagatttatcatcattggacctgagaaaatacagtcaatttattttgattctggaagaatggaaatgaattaagagatttttatagggcccaagaaatccaagtatagagcagatattagatgtcattaattccaagggcataggtccctaaagaaaaatcttcaggatctactgaagccaacatctatgagatgggatgccagagtctgaagaagaagttttaagcagagcaccttcttcctagttcagagaaactcaggtggatccagttccttgaaggcatgcacatagtaaaatattacaatgtgttttcaagtggtaacttctgtttctctcaaaagtctaaaaaaatgagactcttgacagattatttattagatttagcttgaattatctcaaggagtttgtgaaaacttgggaaaataatttagaatctactcagtcttcctaaggtaaaagggggaaaaaagtataccaggagataacagtaaaaaaataaacataacaaatcctcaataaataaaatagaatacagaaaaatagtcaaatgatccactgaaagcataaaaggggaaatagaggaactaataacatagggaacaaatggaaagcaaattataaaatggaagttctaggggtggtgcagttggttgaatggctgactcttggtttcaactcaggttgtgatctcagggccattggaccaagctccttgttgggctctgcactcagcaagtagtctgcttaagattttctctccctctccctttgcccctccccattgtgctcacactctctctcttctctctaaaataaataaataaataaataaatcttcttttaaaaaggaagttctaatccaattatatcaataattacattaaatgcatacgatctaaatatatcaattaaaaatcagagattatcagaatgaataaaaaactagcaagagtcaacaatatgttgtctctaaaaaacccactttataatagatatttaatagtaaaagggtgtaaaaagatatatcttgtaaacagtaagcaaaagaaaactacagtggttattttaataacaggcaagatggatttcagagtaaggaaaattatcagcaataaagagaggcattttatactgataaaatggtcaattcatcaagaagacataacactcctaaatgtgtatgcacctaacaacaaagctttaaaatacacgaagcagggagatccctgggtggctcagtggtttagcacctgcctttggcccagagcgtgatcctggagtcccaggatcgagtcccacattgggctccctgcatggagcctgcttctccctctgtctatgtctctgcctctctctctgtgtgtctctcatgaataaataaataaaatatatttaaaaaaatacatgaagcaaaaactaacagaatggaacaaaaaaatagaaaaatttgggtggagatttcaacaattctcacagcatttgatagaaaaagtatacagattaataaggatgtagaactgaacaacaccatcaacaaactggatctaattaacatttttaggacccaaccatcaacaaccaaatatgcattcttttcaagtgcacatagaacattcaccagtatagaccataccctgggtcacaaaacaaatgttaacaaattttaaaagttgaagttatacaaagtatatttattctccagccataatgaaattaaattaaagtcaataacaaaaagacaactggtaaatttccaaacactggaaataaaacaacacacttataaataatctacaagtcaaagagaatgtctcaagaacattcgaactgaacaaaaattaaattacaagtcaaaatttgtgacatgtggctaaagcagggcatagagggaaagtcatagctttaaaactgtttacattagaagggtctcaaaacatcaatccagttccatcttgagaaactacaagactgggggtgagggcagcagagggcaaaatatacccaaagcaagcagaaggaaggaattaagaacagaaagccatgaaactaaaaatagaaaaagcaatggaaaaaatcagtaaaacaaaaagttgattatttgaaaacatcaatagaattaataaataactagccgaactgacaaggaacaaaggagagggcacaaattatcaatatcagtaatgaaagataaatgtcactacagactctgacattagaaggataatgaaaaaaaaaagaaggataatgagataatactattaccaactctacacacattattacattcaacagggcagatgaaatgactgacttctcaaaagacacaactagcaaaactcactcaagaagaaacagatcagaggaagaagagaaggaagagggggaggaaaaaggagaagaaggaacagattatccaaagagtatctatttaaaaaattgaatttgtaatttaaaatcttccaaaaaagtaaatctcccagcccagatagctccattagcaaatttaaccaagcatttaaagaagacatacctatctcttccagaatatagaacagggaacacttcccaacctatttcatgaagccagcattacctttactatagatagtaaaggaaaaggaaactacagaccaatatccctcatgaacacagatttttaaaaatcctcagaaaaatatttgcaaatagaatcagcaataaatcaattgaataatgtaccataactaagtgaggtatcccaggaatgcaaggctggttcagtatttgaaaaatcaatgaatatagtccaccatattaatagactaaagaagaaaaatcacatgatcatattaattgaaacagaaaaaaatcatttgaccaacttcatcaatctatagtaaaaagctcttggcaaattaggaatagaaaggaattttcttaatctgataagggacatctacaaaaaaacttataattaacatcatacctaataatgaagaacagaatgcttttttcaaaatcaagagcaaggcaagggtgtctactcccatcactcttattcaacatcatgctggaagtcctagcccatgcagtgaagcaagcaaaagagataagaggttggaaaggaggaaataaaatggtcctcacttccctcctcaacaggattgtctttgcagaaaatatggaatctaccccaaaactcctagaactaacaaatgagttgagcaagtttgcagaatataagatcaatttacaaaaatcaattatttttccatatactagcaatgaacacttggagaccaaaattttagaaaaaaaatatcatttataatagttccctaaaacaaaatactcacgtgttaatatagcaaaacataagcagcatctgtaggctgaaaactacaaacacagatgaaagaaagcaaagaagacctaaataaatggagtgacataccatgttcatgaattggaagactcaaggcagtttatttttttttatacaatcatctgatttatagaaagatgcaacaatacttaaaatgatacaaaatactgatttcaaaacataaaaaaatgaatatatttaaccatactcagctcataactgagcaaatgggtaagaagaataattcatactatagcatattgctaatatgaactggcaacagaaaaagttggtataagtagacagaaaaacgatcttttaagaattagaaccgaggggctccataatcatctggcatccgctcaatgttgtacctatggttagaaatgtacatgatgggaactccagggatcttccggatcctttgtttaaggtcccggtcaactgtggccacaatgtaacacttgtgccgagttactctctgtactaagcagtcatctgcataggttcctttgtgtgtgcatggcagtcgttcaaatcttggatccttggcaatccttagagccactcgatacttttgtcccagtttctcaatttcagccattacacagtcagttatacaagggatacacttggcatacagacagtccatcattgactgtactaagtcaagtttggctttaatggaaaagttgataaagttggtatcaaccaggatgtggtaaggtgggcccagctgtgtgttatattggaagaataagcaggaaggatgttgggggacttctctttccttgagtgcactgggatctttcttttctttctttttaggttttaatctatccttttctttaagcctctgatctcggagactaagcattcgcttcatggtcgcatactttcttgctttcttttgcttccccatgttcacgccgcactcttatttcttcactcaagacagtttaatgtcaattctctcctatcataatcctggaaagattttttggcagatacatgcaagctgattctaaaattcatatggaaagacaatgaaactagaatagccaaaacaattttgataaaagaaagtcagatgaatcacaccacccaattttaagacctaataaagctgcaataataaaggtaaggtagtaagcaagggataaacaacaagggaaatggaacagaatagaaagcgcagaagtagacccacataaatgcggccaattgatttttgcaaatgtacaaaggcaattcaaggagaaagggtagcctttttttttttttaagattttatttatttattcatgagagacagagagagagaggcagagacataggcagagggagaagcagggcccccacaaggagcccgatgcaggacttgatcccagaccccaggatcatgccctgagccaaaggcagatgctcaaccactgagccacccaggcttcggtgggtctgcagccccagtcggagcccgcagagttaccatccagtctattaaataattctgtcggggaagaagccggcatacgaggggctgtgctgacgggcctctaaaatgtaattgctgtactaaaggggatcagaaagtgatccttcccaccccacacgctcctccaggccagtcagaccagtctagacacctttccagaaggtgctctgctcttcctagtctgtgctcaactttaactaaggggctgttctcccttcaccaagcaaactccccccacctctcaaaagccctcccagatccccccaggcagagccagtggcccttcctctgaggggtgggacccctgagggaaagatacggctccactatggttctgagaaatgcaaagctgccatgtctgctgcatccgctggataatgatgtgactggatattattttggtgtcttaaaagctcttttttccgatgatctgcctccttgcatttctccttccacttttctctcagctaagtagtcagctctgggcctcactcccctaggaagtagggtctaatgagggccagaaacagggcccctccgttgtgccgccttgccccggtgtcttcctctcacatcatttagagccagaacctcctgccttccggctggctttcccccctaagcaagatttagctcttgccaccctccagaactcctgctgcccctccgtaccaaggcttccctgtctacgcagccactctcttccctccactctcctgctgcaagcccctctctccatttcccccattgaaagatccaagtttctgtgctgaaaaatgaagtcccccatttctcaggacatcatctctgaaaagcaagcacagctccaaagctctgagctccttgatgatacacacatctgtcgagtacctactatgcgccaggcacagtgctgggagcaagagatgcagcagcgaatcaggcagacggggtccccctgccctgtggagcagttgacattctagtgtggagaaacaaaatgctcaatgaaacaagaaagtagggatgcctgggtggctcagtggttgagcgtctgcctttggctcaggtcatgatcccagggacctgggattgagtcctgtattgggcttgctgtgggagcttgctactccctctgcctgtctctgcctctctcatgaataagcaaagaattttttttttaagggaaaaaaaagaaacaggtaagaaacaagacaattgtagaaaacatggcatgtgctatgaagaaaagagaacccaagtgatgaaatgggtggtgatggggcaggggaggctacattggatgtggtggttaggggaagctacctggagaggtgacacctgagctgagacccagactgggaagcagcccactgcataaagctttgcaggaaagaacttccagggaaaggacaaagtgagtgcaaaggtcctgaggtgggagcatgcctagagggggttggagaggcagaccaaagactggagttgctgaaaggtagggagagaaggagtgagtgattagaggtgagcttgatattttgattcctaaaccttcattgaatcaaggccatatctcgggggtgtttggagagggggaccttgagtcttattggtcaggccagatggactctttcttctcttccagaattcccttctggggcctaccaggctttaaggctatttatgggatcacaaagatgcctattggcttcatttctatgttgtgtatctatctgtcttacttattctctgaccttgacacacaaagtgtcaagggtggagaccggctcccatctacccacccttcttttcccaaagcaagtcatcaccatctttgtgtaatctcctgtccgtggcctcttctcccacattatttctcctcaaccacggaccctgctttgaagcctgcatacaaccttctctgaagggccagagcttccccttttatcaccactgactctcctccagacacccccccacccccaccccccacccccacccccacccccgtcccagggaagaaccagccagaatgctccagctgccctagttttatccctgcagctgcagcgaacacgtggagctcttcctcagcctctggccaaactcaccgagcctgtggcctgcgtatcagaagaggcaggggctgtaaatccgaatcccaactccctcaccccacctcactgggaaagagcctgggggtggcagcctaggtcactttgctatggtgacattccagcattttcaacagcagagctcttttctggaatgaaatcaaggtagaagtaggatgggaaaaacagatcaaagtattttgctggtataagtgcacttgatatgctcacacgtttgccatattcttattgtaataagagagaacaattataacaagatcagataagatgagaacaaggttgttttgttgaatataaaataaaagtaagggcttatggatgatgttttctgtccttgcttccaacttgtttcacatttagtgttgtacgcaatttattcacgcagagaagtaattgcaagttaaaagaggcttttctgtttcttctatcatcccttcttgcaataatcttcaattaaacacaggtgcaggggaatctatagccccactcaaagcaaactttctggtgatttcttttttttttataaagattttatttattcattcattcattcattcatgagagacagagagagagggagaagcaggctccatgcatgaatctcaatgtgggacttgatcctgggtctccaggatcaggccctgggctgaaggtggcactaaaccgctgagccacccgggctgcccctctttcttgtgatttcaaatgggctaaaagtcatgtaatctaattgccagcttctatctgtttttaaatactggtttaccataaaatggtatcagaaatgaacttgagtcaaacatttctagactcttcagtgcctccagagtacccaaggctccatgtgcacatgctttggaagctgtagcttcacaaccacatctcactcagcaatccctccacctggggctctgggccctgcccccaaaatccagctgattctgttttccaaagtctaacacagaaggctttgaagcagggggccccagtagagcccatcttctgcaggaattcctccagagtcccccaaacagctactcttccagtctctgcctgaatacctgaagtgatggagagctcgcctccttctgaagctgcctggcctggtccatgatggggccgctctacttgttaaacattgcttcctctctgagcctgtttccttatctacaggatggacataatatttatcaagccgggctgctgtgaagaccaaataagatgacatggagctgacataccaaatgtgcaaaattgcttgtgtccttctctgcccccagagcacccccattttagagggacagacagtcttatgcctgcagggataagtgggcaggggtggggtggggtggggtggggtggggagtgtgcatccccctgggaggtcactaaaggaggactgcctggagagtctgcccacaaagaagactgtagcaaagaagactgtgcaccccccctccccaccatccggtgagcttcgccaactcctccctgcccctgccccctccccccaccgacctcagagtctcatctgtcttccctcctgtcaccagagctggaggcttgtcagggaggcaaggggattaaatcccagggccagcctcgcccccaccaaggagctggccctacattacccacctgcccagctgtctgcggccatcgatcggccctggcctgagtgacctctgattgatgggcagcatgttatttactagattctgtcccaaggcagctgggaagaggggagagggacctagtcagagcccctgtgttcctgaggcagaaagaatcctggggtgggagggtatagagagcaggtggctgggagtgctcccctgggagtgaggggtcctggcccagcacagcagcgtgatcttagctgaggtctctggccttccctgtctctgggcctcagtgtcctctataaaaggatcaggtgctgctggcaaggttcacaaacttagcagccctcagggcagcaggtaatgacaaagtaaggaagcgagttggggctgccaagctgccaaagggggcaccttgctccctccatcttgccccatacctgtctccccccactgtctctgacctaactatagctggggaagcttctttgccctccgtaggtaagctggcccaccccttctctcctccttcctgccatgggccttctttccaagccagcccctgtacctgcagcaggaaaccacaaaaaagttcaccttcttggagagatttatatttgagaagggctttgacagagtggaggacctggggtcatggggacaggattgctgagggtcaccccccctgcccccacggctccgccccagcccctttggaaggtgagcctggtgaggaccacatgatcgcattctagggcagttaatcacttgtgatggaggctgccttgacctatggcttatgctgttatctgctcaggatcttgaccaaaatgcaggagacagggcagttctcagtgcaggatgggcagaggaagtacgaggagaggccacgatgggccccatggactcaaaaccagaggacagcacattctatgagtaatgggtgagcagaaaacctcccggggccacaaagggagtggaccgggcacagacagggggccccagccaggactggagacactcgatgagtaggctctggcccccggccacatatatccttcaacaaacctttgattaaggtaacttgagtttctcttttctttgaagccaaaatacctgaactaggacttgagcgggaaggtcattcccagccctgagcacagtgtaggcaaagatacaaaggcaagacagttaaaagaggtgttcccagcataaggatggtgggtggtccacccaagctagaagagagtgaggtacgggggccacacgtatgttgtccatgtgtgcacaaatgtgcacctgtccctacaaggctcagagatgcagaagatcagaatgtcaaatggggtcagaggccagaagagtgggctggggccagataacggggcggggggtggggagaggcatcagagcatcaggaagtactgtgagcacgtggatgtgtgtcctagacagagctggcccggtggagagaggctggacacagctatggcatggggagctggggggcgggggcagtgggagagtcaggatgagagctggccatgctgggaggacattgccagaagcctggcattggattcctatttccaacttggacaaccaaggcaactatagggctattaacccaggaagagagctcatcttgggtggttggatttgggacctgtgtttttaaggcaaaaccagaccaggcaactggagttactgatcaagagcccaggagagaagtcagtggtttaaagattttattttttatttattcatgatagacatagaaagagagagagagagaggcagagacacaggcagagggagaagcaggctccatgcagggggcccgacgcgggactcgatcccaggactccaggatcgcaccctgggccaaaggcaggcaccaaacagttgagccacccagggatccccgaagtcagtggtttaaaacaatttcagaggcattggcacgcaggggcccatgggagaagagttctccaagagtagacatttgtgcccattagggctcgttaccctatcaccgtccagtctgaacctaattccaatgtttaggatattctgcacaccaagcattctgtgacatcagctgggtgtcctacgagtcatcgcaattggggtactgtcttcctggaagctctctgaacccacatccctttggggttttgtggaggcttcattacacggataggattgatgaaatcatgagccatttggccattggctcaatctcccggctccccaccctggaggtctaggggtgggactggaaattctaaccttctaatcccagggttggtgctcctggcaaccagcctaacgggtttaggtgtggtctccaaattgcctcattaacataacaaaagtcactctgttgctttccaaagggaaactccagagttttaggagccctgtgccagtaatgggaagaacaccagtaaaacaaaccttcccaaccaacctcccttgcagctggtgctggccacgtgacatctgcaggcagctgggccagccctccagacttcttgttatgtgagaaaaaacgaaaggtggccggcagtccaatcttccttgcttgctgctgcggctgcacacattcccgacagattcagggatgcagggagccccctgggacactaggcggcggcgggggggggggggggggggggttgggggttagcaaaagccctgaagctgtggggaggccagcagagtggatgggtgcggacccccgtttggaggcctggcggtgggcggggtgtggacagggtgtgggcttgctgaatggcccaatcctggtcagggtgtccaggagcccctctgcctggggtcagagggagggaaccgcgcggagacgggagggggaggtgggggggtgggggggtgttcagctgcatctgaccatgcagtgtgcatgtgcacacagcaccctaggagggaggagtccctaaaggcttgagtgcggtctggggaaaacagctcaaattgctggtcagatgctttgatctcggttaacctctcacgtggttttctggggctctttttgctgttttggagattcctcaggtctgcaagccttcttgctccactatagatcccaacagttaaaaccagacatagacgggactccctaactcatgctctagcccattgtgtttatgtctgatggtgctttcttgaagcgttgataaagatggtttgtaatgcctggagcttcccaacagccagatcagggaaggccaacagaaagcctagaagagcacatcccacacgtcccctcccctgcccaggatcacatactgaacacacaccctctgcctgctgctctcttgcacatactcccctgaacctctccttttaaactctaggcatccacctgggaggtagagggctcagttgttaaggcttgggcctgctaccaccccctgctgtcaacacccaaaataaatttctccctttctgtcttccaaagccccttctcttgagttactggcttcatttacaacaagtgagtttatccaagtttgtttggcaatggggttggcaaacccagccaggagcttgctttcgatttttccagacccctctggattccccaggccagagcagttgtctgcagcagcacacaggggcttacctgtttctttcctgagtcagtggctattatatatggatcgggaacattcgtatcagcctctgttctagcaacctggacagactcctgtcagccacaggtagctgatttttagggtcacctccttccggaagccctcctggcttgcccttttaccttacagcagtcagtccatctgcctcccacattagccctgggtataacttgcttcttcccaccccacatgtactggaccactagttctcagaccttttgtcgtcagggcccctttacactcttaaaaattatttaaggcccccaaagagtttttgtttatgtaggtttatcaatattttactacatttgaaaataaaactgagaaaattataaatattcatttattaactcatttaaagataaaaattataaactcagtacatgttaatataagtaatatatttttgtgaaagatgactatttgggggaaagagagaacaaaattgttcacattttcacaaatctctttaaatgtctggcttaataggggtgcctattaatagtggttcagtccattaagcgtctgcctttggcttgggtcatgatcgcagggtcctgggatggagccctgcatggggctttctgctcagcagggagcctcttctccctctgcctttgccactccccctgctagtgctcactcactctcctcagataaataaataaaatcttttttaaaaaataaaaataaatggctaaatagaagacagctaaatccttgtatgtgcttctacattccatctcctgccacatgccgttttggttgaagtagataaagaaaatctggtctcacccagataaggagctgagaaagggagaattctagtagcttctcccattactatggatggacattcttctttgatattacaccaaacctcaacatattgtagattctggttttggagtgtgtgtgtgtgttggggggtgcggggtgtgtgtgtgtttaatttagtagaatccatgtctaacatggaacttgaactcatgaccttaagatcaagaattgcatgctctgggagcctgggtggttcagtgttgagcatctttctgcctttggctcaggtcatgatcccagggtcctgggatcgggtccctcatcagcctcacctcactatggggacctgcttctccctctgcctatgtctctgcctctctctgtgtgtctcatgaatgaataaataaaatcttaaaaaaaaaaaaagaagaaaagaaaagaaaagagttgcatgctctactgactgagccagccaggtgcccccacatgttgtatattctttagggtgagttgaagtctggaatctgaaaccttaccaacaaacttttcatactctgttacattaaaatccattggtctatctcatactttgagtggatcttttactcatataagattttgtaacaccacgtattggccattcagaagtaaggtattaggaaggtgtccagctcctggttgcagacaaaagtggtccaaaattcaaacttttgcttgaaagctctgattttatcattggcaacaaatactaacagttgttttccttggggcggtatgctcacttcattcattttcaagaaaatgtatgtcaaaatccaagaaaaatgatgagtttgtccatagttggggtgttctgttttgttttggtttggttccaagtaaaaatggtgctttgtgagaaatggcagctctagcttacaactcaaatgatcacagaagtgcgattctttgaaacgatgtctgtgcttcaggatgctgtggaaatgctttatatgtatttcccacgttattaccagaaaatgaaaaggatgtgtactcaagaatagagttttaataaagttaatgatttttattggcaaatcaaggactcttcgtgaaactggtgatggagttcagggcgtgccacccccaaatatgccgttttgacatatcgattgttttgaattacagttacttgggaaacagccagaacaagaaggacactctgaccctcctttgtccccttgaaagcaggatatgaatgccctgtgtgaaaggtgtcctccctgtagtaggaggtagagaaacatccttatcaccatcagtagggaatttgggaccaagaagactatataaacaaaacctattacttcattgttaatttactattgcaagccctaacttctttgtcttatcaattcttcacaaatttgttgtttcttggcctaaaaggaatgaaagctgcatgttttgggcacttctctgagtctcattttctattttttagagaaagagagagagcatggtggcagaggggggcatgcagagggagagggagagagagaatctcaagcagactccttgctgacggtggagcccaatgcagggccccatctcaggatcctgagatcacaacctgagccaaaatcaagagctggacacttaactgattgagccacccaggcgcccctgggtctcatatttgtaagaactcccatatgtgaaattaaatgtgtttttctcctcttcatctgtcttttgtgaatttaatttttagaccagcagaacaacctagaagagaagggaaacgttttcctgccagaaaagacaaccatggccactgtttgttcagtacagtttcgtgtcaccacctagacatttacagaggcaccagcatttttaagcaccaaggcttgggcaccatccattgcaaatatcagcaccataacaatggcaaacagtgccttagtattattatgaaaatagtcttgaccttgaggtcttcccaccctctttcctgcaaagaatctcaggaccacatcttgagaactgagtccctgaaggcaggagctgtatcatctttttgtttgtttttttgttttgttttgttttgttttttaagatttttacttttaactaatctctgcacccagtgtgggggcttaaactcacaaccccaagatggaggttatgcactaccaactgagccagcaactcttgtccctgtgtccttggcacaaagacagtgaccaataaacatacagagtagtagtcgacactgctgagcactccctgtgagctttcaagggatggattcattccctatgtgacagcccttgaagggggtacttttactatcatgcccattctacaggtgggggcaacaaggcacagaacagtacttctctctgttaaaaagagaatcagccaacctccagaaatgaggctgggaaatgattacactctgtgtttctagttcagttcttcaaagtctacaaagtgctatcaatacaagggaaactcccaggcagtcctcaagatggccagcaggcttcttcatcccagagaaacagagaccccaaatggtgaaggggctgcccgggtctcaagcgcaggtctgctatggtcctggacaccagggctgctacatcagctggaggacagcccctggtctccgaatgcccagtggtgacacagtcccagtccttcaccccaaaatgcttcccctgcggttgggctgtgacctctcctctctggacagtggggtggtggcacagcctcactgatctccacaattccctctggcttgccagcgccgaggcggctgggctgtcaccaaggctgcccagacccggcatgtatgccaagagcccccgggaggtacatcgtccgctgacagaatcagttaacacacagccgcctctccactgtttgctgaggcccctggaggcccctgctcattttctccccctcccagaatcccagaaaagtaaatacctacccagagacgcttcagtgggtaaacaagctagagtttgctctccaaattgcacctgcccccacctccaaaggctaccctgagggctgacaggtttctctgtaattcattgccctggtttctgtgtcacccactgccccccacccccacccgtgtggcctgctttcagggcaggagcagggcgggggtgctctggggtggtgggaaaggcctccctgaggggccggttgctgcacaagctcctcagggcactcaagtctgaatgtggacattcataaactcaaaaggagtgggcaggcctgacggagagtgcaggggacagatgtgacctgcagccatccacgaccagggactctctgacaaagagtgcttcacccaggagccaacccccaaggtcctggccccctggatctctgctggttctctcacggtgtgcaccaggggtcatcttcccgaggctgcccacatccctctgccctgctctaaaatgctcttcgctccgtccccaactttttgtcatcctggcttcttcagatctctgtcccttgccatgctcatgtccacatcactccctgctcttccctcctcatccccaccccactctaaggagcccccgtggctccccctttccccacccctgggtccctctgtgtcagtcaacagaagcgctgattacttgggtcagcatggcagcactgagtaaagtcctggagggccagacccgaggggtccctgccctggagagcctcagagccacacaagaggtcacacataacatgtctctgtgccccatacacactttacaggttcagaacccatgtgggtgaggctaagtttcgcccatggtgatgctccttggcaagtggctgagctggatggactctaggcctgtcccctgactttggaaaggacataatcacagagacacagaacaccttggcctggaatccaacccttgaaagtgtctgttaacatctctgaggctcagtttcttcatctgtaaaagggaagtaaacaatccctgcctcaggagatgataaggatatctgtcacctactaggcattgagaaagcactagatctaggggtgcctgggtggctcagttggttaacatccaactcttgatgttggttcaggtcatgatctcaggctcttgagatcaagccccatgtcaggctccaggctgggtgtacagtctgcttaaaattctctctctctctctgcacccctcacccccctatccacatgcagcgatgcacactctttctctcaaaaaaagcagtagctgtaattagtactactactgagttattattgctgtcaggctagcaatagtctcaaatccaagagtgacttttaagggatagttgtgtcagataaacagcccctgagatggccacctgctatgacttggttgcgggagtgggcgggggtgtggaacggtgacagccaggatcagaagctgaaggccgagagggcagcaggcacagaatccgacagctgcgagtgaggatggcctaagaagattaaaatttggtgtgtgaacatctcctggacctcagcaagagggcaggagtctggctgataacttgctgcagtgccggataaggagagctcgcctccaaatccccaagcccaaagaggagggccctggaggctgagaggctgtctggggacagaaatggtgactcggagccagcccacgagcacaggctgggagctggtccagccccaagatgtggtgctgggaggccccctacattgggaaggctttgctgcaggccggaggggcccctgcccagcgtataggcaggtgtcagagggttcaccacagcatgggccagagcggtacctacatctcctgaaaggcacaatgtcctgtggttaccacaaatgtgaggctcaatggccaggctttgtgttcagaaacggcgctaacacaggatgttgggaggatgggagctggctcacagatctgtgatattggctggctccagtttttacgtgcagagaaatacatttctatcttgttttaagcccctggtagttcgggtctctgctgtgtgacaccaatccgcagttgtcactaatagaaccagctgcagcgccaccatggctctgctgggacgggaagggcagaggacagtctctacagcagagtctctttttatttgttttctgtttactcttatgttacaacttgcttttttggatgggtaatatgggcacataataccacatttaaaaagcacaaaggtttgtcattaagaatagatttgggtgtaaaagagactgtcggttggtagtggctgaaaccaggtggatgtttctctctcacctgtaagtctggagcaagcaatccagagcatttctgcttcctgaagagcaaagggatccaggctccttccagcctactgatcctccacccctgggtgggtccccttctctgtggtccaacatggtggtcatgagagtggtgtcccatgcaacaggaaagaggccagagccaaggacacactagctgtcttttaaggatgattcttacaagcagctgcatgatgcctctacttacactccagagataagaacttaatcacataaccacaccaagctgctggaaagaccaggcaatgtagtcttctccgggcacccatgtgtgcaaggggagaacggatgctggtgaacatcagtcatacagaagaggtgcagtgaagagtctctggcagagattctctgggaagggacatcagggaactttctggggtgatgtcatgttctgtatcttgatggaagttggattacacaggtgtatacattcttcagagctctagaaatgcttcactcaagatttgtgcattttgttttatataaatatctccaaacattaaaaaaacaaacaaacttgtaaacaaatactgaactctagttaatgatgcacacccggcagtgcttaggggtggagtatactggtgcttgcaactactttgaaatgtaccaaaaaaataagatggctggagacatgtgggataaagtaaatctagcagaatgttaattgtagaacacaggtggtagatagaggggtgttctctatttgattctttcaatctttctgtatgcttgaaaattatgataaaatattggggggaaagtcccccttacacccctctatcctcaagccaccaaatcttcctaccaccttctcttggatcccactggcaacagcctagacaggtgctaacataccatctacacagcagtctgtcttatccaattccagcctggtgtgtgggctgtttgcgcctgggtgaagagaaaccctttgatcaaaaccctcctgggagctgctgaccactgagctggcccaggcaatccaaaaaggtggcccctctagagactccccctcatcccctcaaatccctgtggctttctggctgccctccagcctctgtcccaccccccacctgttcccaggagtcctatcagctctggtcctctccctctctcagccccctctctggttatcaccacctcttcaagagccttcctgccaccacaaagccttgtaaaatctaggtaattccttcccagtaccgccaataacccctcctgcaccctccccgcccccaacttccccaacaaaagaggatgaatcctcttttgcttcctgggtctcttggtccagatctctccttcagcctcttggcccctggggtttcctgccccgctttctagctggtcatcccagggacccatcgcacagaggagagcctctgcttggggctctggaagggtgcctcagtgatgagggaacagaggactggctgaggacaaaacacagcccggggcagcacattgacaagttcttgaaacaggcagagggaccttcctctacagactcaactgcctggatattcatactttgctaaggactaaaggcaatctcagcccgacccccaggatcctgtaagtctactttaacatgtaaaaattcctttatctctaaacccccatatacatgttggcaaccatcccccatatccatctgaaggtctcatgactcaagttttattagacggtaataagtgaccttttcccaacaacagctggccccctcaaggttctggaaaccttgcttccaaaatcccttaggcacttaccctatccttaaccacctcccaactcccaggaatataatcagccacctctcatgggctcagggcagcagctcttcctgcccatttctgtccccctgctttaataaaaccaccattttgcaccaaagatgtctcaagaattctttcttggtcgtcggctccagacctcacctatattgcaaaacttcatcactcagggaggtgccattcaggtgagatcttgaaagaagaccaggctgagtggatggcaccagtaaaggctggaagtgcaggaaagggcaggttcaatcagggaacagagatgaggccagccctgccatggtgatgcctataggccgaggagggaaaaacagagggacccaaggccccagagtgtgggaggccagggccttgaggccatgcaaaggaatgggagcttgctcaggcagggagggcagttatggggtggcatctacctcctcagaagctgaagaggacagagccaccccagggccccagagccccaggccttcagggagtggtgggacgtggggatagcggggcgcagaggaaaaggcactttgacttctgaagaaagggctttgccgacttcccctccatggggggcgtggcaacctcaggctgcctccctgtgaggctggaaagacgtgttcttcatggactttcctaacaagaccctcaagccctgggcctagagacccaaccaggtattgatcctcccccagggtttgaagaaaagcctcactccagcttggggtggctgagggcactgctctgaaatcccagccccctacctccctttccctcctcctcccaccccaccagctccccctacccttacccagctcccagctccagcctctgctcttcaccccagaacccctcccccagaaagccctacctgaccctcctcccacacaccaccaccggggagtgggagtgggagccctttctccatgtgctcttctgtgtgagctttgctccacctccacacccacctccgtgtgttgcagctcctagtttaagacagggccctgggatccctggggggttcagcgggttagcatctaccttctgcccagggcgtgatcctggagtcccaggatcgaatccctgcggggagcctgcttctccctctgcctgtgtctctgcctctctctctctctctctctctctctctctctcctgtgtgtgtgtctctcatgaataaataaataaaatcttaaaaaaaaaaaaaaaaagacagggccccattagctgtaagcaagttggtgtgtgcgtggcaggtgtggggggagcggtttttccagcttctgggtggccgtctttcctactgtgccctaaattcactggtagctattcagccatcacttcaggtttgcaccctgctggtaaaatggtctatctctatgcttcctttaaaagaggacacagctggggtgcctgggtggctcagtcggttaagtgcctgccttaggctcaggtcatgatcctgggtcctggggtggagagtccacattgggctccctggtcggtggggagtctgcttctccatctccctctgctcctccccctgcttgtgctctctctctcaaataaataaaatcttttaaaaaataaaataaaagagggcacagctgtcacaagtaggatgtaaagatatggatgggacaagtggttggagttcagtttctcggtgctagattggagtggggggcaaatcctggaactcacaacctgcagatatgactgatctagagagacaatggcagcgtgttactactccacgtttccttataaggagagggggaaaaacacagcggaatattatgagttagagagaagatagtggcaagactcagggaagttagggctcagcaccaaggttatgggcgtgtttgttactacagcataactgcacctatcctgacaattgtgggatcagataggagagcagcctctgtctcccctttatacaaagagaggtggtcacagagacacagggcagcatcttcagcctcacagcactccccaatcaatcattcaatgagtatttactgagcatatactgtgtcaggcatgttctaggcactgagaatgctaagtaacaaacaagagttgaaagtccctgccctcatggaacttacaagtccaatagggaagacatgaacaataaaaaaaaaaaaacaaaaacagatacatatcatgtttttatagcactaatgaaggaagaaaaagcaacaccagaagatggaggcctagggagtgtgtgctattttagatggagtagtcaggggtgcctttctgaggagacaacatgtgagcagaggctagaaggaagtggaagagcatactgcatggttatctggggaaagatgggtccaggcagccatgatagcaggtacaaaggtcctgaggtctgcttagcacttggtatgcatcctggaagctgaagctgggaccaagacctagctcactcgctctcacgctcactctccagcagctaggaaggacaatattggaccaggttcaagagaagcaagtcaggcaggctgccctgggacctccttcctttgaatccccccaaaccccagctctggatgccccctgccagccctggctgccctccctacgtaacaggtagccacataagctgcttcatgccaggaatccagagcatgccttatttgcaaatgccataacgtctgactacctatcatgactctccccaacctggatgcgatgagccgggaaccagacaggggcaagtcctgtccttgcccacccttacttaggcagcctctttattgtacaggtgtgggaggaaggaggaaaccttgttggtatatgtcccacccccaacccctgagagcaactagcaaatgagggccctgcagagagcttggagcttgtggctataggcccagtggaaggttacaaggttacctggaatgccccaggtgcttctaaatgatgctactttgaggccagtgaagctgtattccaagcaggccatcagggctgagccatgaggtcatagggccaggctgtctgggcttgagtcccacctctgtccctcactagctgtccaccttgggtgggttaattaccctataggtacctctcccctataaactggggatggtaacaacagggttagtgcagagctaaatgagataatatgtagcccatgacaagtgctatgaaaatgttttttaaataaaaaggaaagtgcttagtaaagtgtattttaaaatcagtctcttccatgtaattgtatttaaaatgttcagtaagaaaagagtttgccccctttaagaataatctggggagaaactgcttctgtcagcacaaagtcagtgattaggaaccaaagcaagagttgccaatggtttaattagttcttttcagcattaaagccaaaccctcaggtctgcacaggtgggtctgctggagtggtggcagcttggggagagccagcactccccggtttgaaggcacctgctggcagtgacctgccacccgagcctcagccagcgggcagaactgagctgtttgagcccaggacccgtggtccagaagctcagcctataggcatctgaccctcaacagccaaggaggccaaatgtgaaggggactgtaggtgcccgggcttggaagctgagtgatagaataaaatataagtgtatcaagagaatggaaagtctagtgataacaagaggagtatgtcaacaagccaccagggcctggcctgcattatctgttcaaactttctggacagatgtcatctttctttttccagctctttgattacaaaggcactttcagtttgcgcttaatcggaaaaaaagcatgactggagggaggtgggcctgagcctggtcctttctagttctatgcccacactggtggcatcagtcttcccttgaggccgaaacaagcaccaattattatttactcagcatctactgagtgccctgcaatgtatatttttcactcttcacaactgctgctccacactcaggcacactcccattgccatctcacagatagaaagacactgtaaatggctgctctgcaatattgcccacagagcaggttttcctcaagagtggtgttcagaggggatccctgggtggctcagttggttaggcgtctgccttcggcccagggcgtgatcctggggtcccgggatcgagtcccacatcgggctccctgcatggagcctgcttcttcctctgcctgtgtctctgccccccctcccacccccgcctttgtctgtgtctctcatgaataaataaataaaatctttttagaaaaaaaaagagtggtgttagtgatcaggacggtagccagggtcccggctgcccatttctctccttagatctctccatatgtccctttccttctctcagggcctcatccctgggtgtccctcggaggcgctgcagccaggcactgaacttcctttgagcaacagcagtcacagggatggaagttaattcccaccaagtgccaggatgcagtggaatttaagagaagtcaggatgctagaagaaattaaggaagatattcataaatggagagatacaccatgttcctggactggaagtctccatatgggtactgtcaattcttcccaaaatgatctgtagattcagcacaagccgagtcaaaggcccaggtggtttctatggaaatcgacaagcctattgtaaaatgtatatgaaaatgcaaaagacctaagataaccaagagaatcatgaagaagagcaaagatgaacagcttacacaacccggttttaaagttttctataaagctatggctattaagacactgtgatattcatttaagggcagacaaatagactaatataatagagagaatcccaaaatagatccactgatttataacaagggcactgagacatgaccccaaagtatgccactttggcttgaagattttatatatatatatatgaatttatttatttatttgagagagaatgagcaagaaagagatacatgagcaaggggagaggcagagggagaaacagactccccactgagcagggagcctgatatgggactctgggattatgacctgagccaaaggcagacgcctaaccaactgagccacccaggcatccctggcatgtagattatattgaattgaaggcaattaagacacagcggactcaagaaaaacttttacttctcccttaactactggaaaggatttgatagggagcgtgagtcacagagctattaccagagataacttttatctgaaggacctacttctatgtcagggtaaacatctaatcaccaaatatctgccttccttattgccctgtgaattaaccttctccccttcaaagccctgggttcctaaaccattcctaagcacaggacagaatcttagcctcaactgcccaactggcccttgggtctcatatttttataggcctcccacatgtgcacattttttaaagattttatttgtgtatttatttatttgagagagagagagagtgaaagcatgagtgggggtgggagcggcagaaggagaagcagactccccactgagcagggagccagatgcggggctcaaacccaggaccccaggatcatgacctgagctgaagacaggtggttaattgactaagccacccagacctcccaatttgtttttctcttgttaatctgtcttccatcaatttaattactagaccagccaaagaacttacaaggatagaaggaaaatttttcctcctcaatgacaattcagtggagaaaggattgttttcaataagtggtgctggaccagttggcttatttggatcatatagggggataaaagcttgactccctcatactataaacaataattaatctgaaatggatcagagatctaaatgtgcatggtgaaataataaagcttctaggtaaaaatatgagaatatttgcatgaccttgggataggcaaacatttcttacacataacacaaaaaacaactaatcaaaaaagaaacaatggggttcattgaaatttgaaacatctgttcatcaaaagacaaccattagggggcccctgggtggctcggttggttaagcaatgaactcttggtttcaactcaggtcataatctcatgggtctgcatgcagtggggaatcttcttgagattctctccttctgcccctcccccacttgctccctctcacctctctctttctctctaaaataaataaataaatctctccactttactggcagaaaaactgagacccagagaaggcaactagcttactcaagagtgaagccaggactcaaagccaggacctcaacttcatcaggacctcaacttcatcaattaaatatctatttcactcaggccagcaactccccagtcctctactggaaaccgctgagagcttgaggcccttctgcccatctcaacatctttgtccctccaaatagcctcgtcccatgataggcaccagagggaagaaaagggctagagagggggcaactggggacagaggggggactcacctagtttttgatgagaggggctgggtgtgtatgtgccacttgtgtgtgtgttggggctgatcttcctgttgaggcaaggcctggagggctcgcttgctgagtggaaagcctgagggtgctctggccagcctggggagatcctgagacctgaaaaccctcctaaagccttcaaaggcattttttttttccaaaagggaaactgggctgttgccacgtcaggctgagccacacaaaatcaatggtgcttgctaatgaggagccactgtcagtacgagtgttgatctgagcaccccagatccctccagttccatatgtgttttgtccaaaacccaggccagccccattatcctgcttcccagtcccactcgtccactaagggtccctctggagatcagagcagaggcaagagacgtcagaggcagcaagagtgcttgtaggtggaaatgagggaacacaggagctgagggctggggaggccatggcgagtggccatggactggtaacaagaggtgacctccgtgcccacacaggtgttctaatcccaaaagactaaacacagaaggaaatcatgagagactttcttgcaggaggctgggcggtgcggggctggggctgttctcagaggacagagggaacaggagagacagggctggggtcagggccttcctctcacataaaacatggcctaaggtttgaagaacaaaagctgacacttcttgaagactcagtggcacactcttcaagaagagaagactcttcttgaagagtgtgccacccctcttctaagacttcctgtatctagatcagtgaatccctacagcagcgctatgagatcaatacaattattctcttcgtttcccagatgagctaacactggcacagagatgctaactagcattcccaagaccacacagcagtaagtggggaagacaggagtcagacccaagcagccaggctagcctgttctccaatatccaccatggtaggatgtgggggtccctctctcaacactgagcagcccatgcatattaaagtgcacaccactgccactgccgggcaggcatccagccacagtgtgcagcacacagagctcctgccattacacagatcccagtctagggggctccccaatgctgctgtggggggtctcccatcggcatgtaaatatgcctagggtgtctcaccagagcagctcagggttgaagatatatttatctgccgtcacaagcacgattccttctcatcctcagcctcaccccaatcttgcaggaaggaaggaggaaatgaatgaggaccagagggggaagagatttgcccaaagtctccaagccaaaggggcaagcagaaatgtgaaccccacacacaatggatgcggtctctcagaggcaaggctgtcggcttcctcgggctaggctgtgatcacagctggctgaacaggtggtggtgggttgaaagcaagttttggggtgctgttcaatcggtgaaccagccgcctctctcagacaccccccacccccccaccccccccacccccccccgccatggaaaacgctgcccggcgggtgcaggtgagctagcccaggcgggtgcgggcgaagcccagacagcgggggtggggctggggcgctggaaggctttgggggagcagaggtgcagctggagccgagctgggtgcggcggcttctgcggtctccatggcgatgcgggggcggggtgaggggagaaagacggaggagggaggcctctgcgcattgatcttgctccagtcagattcaatcccgagtgaaaatggattttttaatgcgtctattagctgctttgaaacgcaaattgagttcaggagagacggaggccgccagcagaaacaatttggcgtctgaggccctcagtgacaaggaacaccccagcatgggtacccgcagctcagcctcgatcggggggtggggggggggtgggggggggtgatacactggggcttttcctcctctccggtctccaggatttactgggagctgtgactacccagcgcttctacagaaactaccaaactgtggccctggaggaaagccagttccagggaagagcacgatccagggaggcttcctggatgaggcaggattctaagaggcctttgaagacacacactccacccatcctggggtcaggtaaaaaaataatgcccagcaacctttggcccagcactctacaacttataaaacgctccctcacttgctcttagcatagtcgtcttaaggactgcagagggcgggtgtgcaaactcattttgaagtaaggaaatctgggttggggaagaatgtcgttgccaagatcactcaggtagagccaaaattagacttccccatggctgctttgtgagcctggcctctctgcgtgccaaaggagctgcaggagctggtgtggggcaacgggcatggagagcaggggtcctgattggcggcgctgctggctggcagcagggctggcatctcaatccgctttctagagaggtttaggagggggctggaggaagcaggatgctgtggggagagatggaggtgccggtcagatacacaattacttctctccattgtcatttgctgtgtagggagacttctttgcatatgcaaatgagttcatcctcctacaattacacagtaatcagaagcaaattaccttcttgctgtttacttttagcgtccttaattaatctggttattagacgattaatgaagcttgtttggtgagaaattcatagaaaaagtgtgtgtgtgtgtgtgtgtgtgtgtgtgtgaaggggtgggtgacactgcatttatccagaaatagaggcggtccctgggcttcccctcaaccttctgagcctctctactgtcctctctcctttcctgcacacaccctaggcccacctctccccagtcctgccacgctcgtgttccttcaccacacctatgtggattggagagatgaccccaggatcctccagagtcccttgagggcatgggtcccaaataggcctggaggcaaggcagtgaattcccagagccactccagatccccttaattcacactccttgtattcactgccacccctgggctgtgcccaggcagtgttcccaaggtggccctctctcctctcaaggtacaagcaacctcctgcagcctgtgggccaggctctgcccaggtattacttagtgtgccccaaacacccacatactaggctgtgcaaccaccagaccctggctaaggggatactaggattatatttctttttttttttttaagattttatttatttattcatgagagacacagagagagggggcgggggcagagggagaagcaggctccatgcagggagcctgacgtgggactccatcccaggactccaggatcaggccctggactgaaggcagaagcttaaccgctgagccacccgggctgcccctatttcttttaatatttgaaccataaggccctacccactcatgttggtggcagttggacattcctcccaaggtacccttcccttggtagtctttgggcatcccaaggccaaatgtccatgtcccataattctatcctggaccctttgtgatctgactgttcctatctggctacttttaaggtcttctcttccctttggagttctgcactttttttttttttaagatttttatttattttttcatgagagaaagagagagaggcagagacacaggcagagggagaagcaggcttcgtgcagggatcccgaggtgggactcgatcccgggtctccaggatcatgccccggaccaaaggtggtgctaaaccgctgagccaccagggctggcctagttctgcactttcacatgatgtttctaggtctgggtttctccttatcgatctgcttgaattcatgcttcattcccagcttttgtctttttttttcatttttggaaaattcctaatcaatatattgttaaatatcacttccccagttctcccagttgttgctgcaagaatgcctagatgacatttgttaaatttcccattctatatcccatgtctttttcccacttgttcatattgttctttgtgtgccccataatagctaacaaattctttatatctattttccagttcactaactatatcttcaacagtatctaatctgttgtttaacctgtccattgagttttaactttcaacattatcactttcatttctgagtctttgttcattttcatgtttgcctgattttcctggaggcatctttatttctctaaacattttaaacaattttttaaaatattttaaaaaaatttttttaatattcaccctaatcaccccaatctccccaatatcttaagccttgaaggctaattctatcatttgttgttttccactgactcatgtatgattatttcctcatgtgctttgtaattctgtattgtaaggtcaagtttggttgagtactatccatgggaatcctgtacagcaggagtcaagggtatgtccttctcaggagaatttgcttttgcttctgccgaatgccccaggtactaccagcatacttcggcttaaattcatcatttggagtttcctggaacacatgggtaatgcaaatgcttaccctaaacatttgtgtgggtaggcatgtagttacaaatggaaaagctttttttaattcctgaagcatgtgctgaaatagacaattatcatttctctttgccactggatgggtattttccctctctatcctttcacccaagcgcagccctggcttttggcagaggtctcaattacaacttcccaccatgagtgcccacagactgtttctttcttcctctagacctttatttctggacctggaaaactttgttccacatgagacatatctggttgtcacagctggaggagggagttgctattggtatctcccgggtagaggccaagattgctgccaaacatctacaatgcacaggacaggcctcaccccaacaaaaaacaatccagcccaaaatatcaacggtgctactactgagaaactctgatataggtcatggagatgtatgtgcaaataacctgaggtctccttgcagctttggagctccctaacacccaggcttccagcatcctctttatgtttgacattctaaaggttttcctttcattcattcatttgaaagaatagttgtcattttagggagcacttctgggtgttctgtaaactacttgtcactcctgcctcattccatctatccacctctctaacatttgctgctctggctcacctctcattgtctggtaaccaccttctctatttctccccctctccctgtacctgtgtgcacctggaagccccaagaatgttactgaaggcttgggagaccatcaagaccatcctgagagggtgtgacatgcccaccagccccagtgactcttggggctcaagcccctaaatcctaccctcatggctcctgcctgattccataatgctgaggcctgatcccccagacttccaggtctcttcacccaccctgacccacagagagtgccctttcctcttcccaggccaaggcccaagcagttcccatagcaggaatattcatcttgtccttggagtctgtgttggtcttgtccactctggtgcctggtgcctggcccacagaaggcactcagtatggacctgtcaaatggatgaatgaatgaatgaatgaatgagtgaatgaatgaatgaaaggggcctagtttctggcccaggcaaggtagtcatagtaactgagcatagatttcccctagtctggattattcaatatctacatgacactgttgggaaagccacagtttagctgagttccccaaacacacatttagggaaaatggttctctaatgctttaagggcacaaccaggctagaaatgctcccaatttacacaacttagcacacttaacctgataaactgccacatctgcactccaatttgtggtgactttatagtttccttcgagaacaaatagaggtgggctctggcttgtttgtaaccacagggcccagcctgggatgaggagaaagtaaacgaagccagttccaaagccattagttcaccacctccgaaaacccaaactgcacacaatggcctcttcctggatgaaacaaaacaaggtctctgttgccctagcagtccttggaattccaaggtcattcacgccattcattcattcaacaaatgaatagaacatcttccgtgtggggggcactctttctggcattcaaagtttcatagaaaacagtgtagagtccctgcccactcagtgcttttgtccgcctccctgcccccaaggggagagacacaatcagtgtattgtgtgatgccagagagtgatggtgtccctgagggaaaatgaagtggggtggcgaggagcgatgggtgtgctgttgaggggcaatctggaaacacttctctgtgaagacaacttagttgaggggagctcaccagcattagggagaagaaggttccatggtgaaagagcagtacttaaagctggatactgagacatcctgagctagccaacaggatttgctgacacaccggatgaagggtagggattaggggtcaaggttgaagccaaggcttcttctgaccacgaggatggtggggtcctctattgagagggcagaggaggaaggtgcaggttgacagatgctcaaaggtctggctctgcacacgccgaggtggaggtacttggtaatggggttcaggacatactaccccaaaatatggcatattgaatattttaaactgaatccctttgagaaaaccgctttcttccctgaaagagatcataaaactctcatgtgagaggcactttcccacctggaggaaaggagcttccttatccctgaagacaaagcaatgaccagaagaaccttgttacgttcccatggtttgctgtacttccctcgcactttctaacccatcacatttctgtaggactgcccactcttcatcaaacctagcataaaaatactccggtctaactgtctctctgggtcttcattttttatgaagcctcctgtatcatgtaagacctacagtaaataaacgtgtatgcttttctcctgttagtatgtctttgtttttattttcaggcccagacagagatcctaagagggcagagggaaactcttcccttctctacactggcagagctgaggagtgccacagggggctacatgggtcaagctcaggtgcaagaacagggataaagatgcacatctgggagtcaaagccgcaggactgggggatgggggtggacattggagaagcaaaggaggatgtggtggcctgagagcactgaaacatttcagaagtcattaaatgtacacatcaggcccatcctgcttcaagctttccagaggccttctggctgcaatctaccaggtcctgggcctctctgtcctcacttccttcatcactgcccccaaatcactctgcaccagactcagcctccttgccagaccccttcccaccccagtgcctttgcacacgttgttccttttgcctaaaaatttcttcccctgcactcgttccctgacttcctttttcttggagtctcctctcaaaggcagcctcctcagagaggacttccctgactctccatgctaatatagacagacagacagacacacacacacacacacacgcacacacacatgcaccattattctctttcataggaccctgttctttgctttcagagtacttattacaaactgtaattatttctatatgagtgtgatgatttgaacaatgtctgctcctcttcctcttcttgatcataaactccatgagacaaggaacattacctgtctttcaccattgtgtacagtgaaatacacattgaatgataaatggctaaggagcaaaaacaagccctggttgatcattgcactacattctcaatatcataccagacctcttacataactgactgtggcagacgtcatcgctgctaaccaactcatctagtcctcttctccttctgggcacacaggattacaaatcctcatctccttggagttacatggggttatggaacctgctctggccaatgcagtatgagcagaaaggaatgtgtcactctcaggtggaagcatttaagagctattatgcaagttctgcatgtgctcttctcctgccaagaaacccttgtggggagatgataagggagcctccatcatctgtggtccctgagtaactatgacaggagcacggtcctctccccccttcctgcaagcaaggtacaaaatctttgtggttttaagcccctgagaatttggggccatttgttacacagcataacctagcccacctgactaatactcactgaattctcctgacagccctgtgatgtgcttcccacacccacttctcagaatcactcaaccaccacatattgatggagtccccactaaaagcgggcattgaccacacaaaaagaaataaggtatggccagcccctgagaagctttgtggtcttggttacagaagtggtcaagaaaactcaagaaagaggaatggaatggaggcacagtaggacttgtcccagaggaagaaatactaaggtagaatcttgacctaatggtgcccttgtccaagcgagtacaggtggaggtggtagaaggaatggcatccctggtacagggaccaacataggcaaaggtgaagacaagggtaaaaaagttaaaccagcatgatggagaatcagtggaatataggtgccttagttcaaggacatgccaagctgctgttagagagactgcaaaatataatggcttgaagacagaagctgagttcttccacacaaacagtccagagctgggtgctcctaggcttaaacttggctccaatctctgagttcaaggcagctgctccagctcctgccatcacatctatatcccagccagagggaaggggaaagcattaagtggggtgcatacccactcttcatagagatataaccaagaaacacaagttaccactcttcccttctagcaactccaccacccagttatccaagccaacctcagccccactttttcccctaagctaccctctgcaaccaaccaagtctctcctctccagctcctcacttttctccaggtcctcgcctctccagaggtgcaaagcagtggctgcctcataggtctcccagtctccaggccaggcccttccaaaccatcatccatatcatgtccatcccactttgtagttctggccaaatcactccctgcaggccacttggcagatcctccgaggccctcctcccctcacccttgcccacctctccagattcacttctctcctctggactgctcatctccatcttcctgatgcccctacttggctcctcctctcaaatatcatgttatttatcacctctgtctctttgctcatccctgaaataatctttcctgcttccagcttacagacctctcatcctcctgggactggctcaggtgctactcctttaggaaatagactcaaagatcctgaactttggatgcatggacctactttcccccttagttcataattatttcttcaagctagttgctccccatctctggtaactagcagcgaacctgggcgcatggcagcactcaggaaacaactgaagggagaaatggatggtgggcagaagccagtgcagattggaggctaagagcaagccccggagctgcaccatctaggttcaaatcccagctccaccatcccctggctgtgtgcacctgagcaagttattttaacctctcttagcctcagtgcctccacctgtagagtgacaacaaaaccagtactccctttatacagtctttgcaaagatgaaacaatgggcgttgtatttagagtagtgcctggcactgagttagcccttcttgttattattaggccaacatcactgaggaacctctgataaaaatgaatatggaatagcatgagcatatctgcatcttagaaagataggaggacacttccacttccaaccaaaatgaagtagcagggaccagatttactttactgtctgaaatagcaacataatgcatgaactacatggaaccctggttctcaaatattggatattaaacaacaaatgacagtggtccttgagacatgagaacaactgaggtgagctctgcaattgtcccccatatgcccagagatagcttccaggcgctggcatgaggagaggggacccaggcagaccctggagtctcctatgtttgggcagacagagaggccaaggtgggtagagttcacaggtcagaggccagggaggaaacagctacgcagagagaatcccaaagagtcctccctcaagagttcagctgaatagcaatcatgttccagcaggaagcactgcagctgtttagagggaacgatcactaggattataaatgccccaccagccagagcaggaagcttagaggttttgcttcatagtgggacaaaacgagccctgactaaatgctgttctggccctccctaacaaagctggaaagcaagacctgaaaggactgaatcatttccaagtaacttaaccacactctgtacaaagctcaagcatatttatatgtatacaaaaataacccgcaccctatgagataaaattcacaatatctgacatccaatatggagtgcctgggtgactcagtcgattaagcagccgactcttgattttggctcaggtcatcatctcagagtcctgggattgagctctgcatttggtaggaaatctgcttaaggattctctcttcctctccctctgcccctccccatgctcattctttctctctctctctctcaaataaataagtaaatcttaaaaaaaattatccgttacacaaagaaggatgaatatgcagcccataatgagaagatcaaccaatcaattgaaaacaacccagagggatccctgggtggcgcagcggtttggcgcctgcctttggcccagggcgtgatcctggagacccgggatcgaatcccacatcgggctcccggtgcatggagcctgcttctccctctgcctgtgtctctgcctctctctctctctctttctctctgtgactatcataaataaataaataaataaataaataaataaataaataaataaatagaaaacaacccagaaatgccatgacattggtagacaaggatattcagtattgtaactgtattccacatgctcaagaagccagaggaaaacgaacacttaactggaagacatggaagatatgaaaaaaacccactcaaacctctggagatgaaaactacgtactgagatgaaaagtgcactgaaaacaattaacagcagctggacaccccaagacaaaaaggttagtgaacttgaagacatagtaataaaaatatagaaaatgaaacacaaagagaaaaaaggcccaaaatgaaagactagagcatcactgcattattggacaactttgaggcctactgcatgtgcacagaagtccctgaaggagagacgatagacgggaggacacaaacagtattgaagaaataatggccaaaatcttcccaaatatgaaagccgcaaagccatagatcccagaagctccacgaaacccaaacacgagaaacatgaggagatgccacaccgaggcacatcgtaaccaaattgcttaaaaccagtgataaagaagaaaccttaaaagcagccagaggaaagagacattatatacaaaaggacaaagatcaggattttgggcagatttctcccgggaagcacagacgccagaaggcagggagcaacgtgtttaaggaacagaaagaaaggctggaaccccgggggcggggagtgcgcgtgcggaggcttgaagtccagggcggcagggaccgcggagacttggggtgcgaggccgccgcaggcaaggggcggggctgctggcccgggaggctggaggctgcggatcaccaagcggaccgtggggcagggccacatttcggagaggctatggcttgcaccctggaggattctgagtgactagcacggtgcacagaaggtgtggtggctgggagagcgagataaatttggcaggtgcccgatgatacattagtcagaacaggaaaagctagaacttagaaacaaatcctgaaatctcagcatcctaacagaaaagcttattttttattcatgcgaagttcacagggggctggcagaggataagctccgaccagtgagtcggagaccccggcgccctccacctcagatccgccgtctgaacccacgaggaccgccgcggcccccgcgagagaccgggcccgggacacccgcgcctgcgccccagcccggaggtgatgggcgtggtcgcgcctcgccgctagctcattggccagaagtgtcacgtggcctcagcccacctgcaagggacgctgggaaatgtgggggacgaatgtggaatgtcgggcacgtgctgaggctgcgcggccagacgcgagggaccccggacttttgaggagaggggaagagggcgtggaggtggcctggagcccccgagggagccccggcgtttgaggaccgaggggaaggaagccctaacccaccggggagggcgagcggggccctggagggtgaggcagccaaggctccagcgcaggcgccgggcccctccggacctgctgtgtgtccactcggaggcctgagagcgtctcgcgtgggtactgttaactgcgttccacggggtcgggcggccgagtggccgagtcacggtgacctggcggggaccagagccagggtcttccgtcgagctccgctccctgctttcccaagggcccccccagaagggacagtgtttaccaggagaggtctgccggcgcccccgcccgcccccgagaaccgtgcctccctgatttcccgggctgaccagggcggtggtgaggagggtctttcccgggtctcccagatcctgacgaacttcttgacccctgggcctcggtttcctccactgctgctgtttgatctgtaggcccggacaccacactgtggcagagtgtagggctggcaggctcccccggactcgtcctgctccctgagaaccccaccactctccatcctcttcccctgccccaccatcttaacggagccccctctggtcagagacgacccagactgggaatgccaaaggccctgatttgcatacacaagctcctcccccacctcttggtgtgtgcacagtcgccatagcaacatgcccccaagactctcttttgcagtcacctccccttactgtactgctggaatgctggctccctacccaggctcccagggctcagagctcaatccctcacttcacggataaagaaactgaggcccagagagggaaagcaagttgcccgagattgcactgtgagttagcagcagagccttatgcagattccaggtctccccattccaactctaggatgcctgtcaccctgagcgggtggtgggggtcacctccccacccagtcaccagtatgatacattcaggctcacctcaggcctctggagaagaccttgggcagctgcaatgaagaaatgatcactggactttgggcagagactcagagatagagccaagcactggggattgtggagggggggggtgcagctaagtaggtccctctgggtctccagcccctctcttcaccccctaactcattcattccacaaatattatatgcctgttatgtgtcaggtactgcgctaggccctggggttcaactgtgatcacgctgaccaaaactccctgccctggtgggctgacactcctgtgggaggttgaagatgatgaacaaagtacgtgaacataatacaatgttgggttgatgtgggttcagaaagtggtgaagggatcacttgctgcttgagttaaggtaacctgcatgttctttcacggcttacctgtcccttattctatgcctcagggcagccggtgtcctgacacttgactccaagatgattgccgaccaactgatgtgttttgggcaaacacaccttggcccatgagtctgaggctttaccaatagaattttcagtggcatagggggcagttgggaagatgtttggggtgagtgggctccccgatgtgggcaactgcctttcctgttcctagcatggcctgtagattcacagtcagatttcagaggcccccaaaagattgctggcctgccaccactcgccagcatcaaaatactgactttagcggagttcctggtgtggaaaaacagcccttcacctcatagtgagaaagaacagcaagtcacaagtgcccctgagagcagattccagataccaggctctgttagcagaccctttcctgggagggagttttatctcactttctgcagaaattttcaaacatgtaacaggagagtagtacaaagcactcccaggtgcctatgtgcagctcaggaaacatcaactcctggccactatggttttagcctgatccccttcctgcccactggaatgctctgaagcaaactggggctgctattataaggaaaggagggggagaacaggaaggccctcccaaccaaactgggaagaggaggaccccagaagtgcaatccaggcaagccaacaaggctcagggcgtgatcctggagtcacgggatcgggctccctgcacggagcctgcttcttcctctgcctatgtctgtctctcttgaataaataaattaaatattaaaaaaaaaaaaaaaaaaaaggaggcagtcttgggcagggagtaccagggtggaccttgaagctgaggaaacccaggggtagctgcatccaaaacaggggctcctggttctgccaatggggtaaaggagcctggctgtgagcaccaagccccatttcctgccccagtttcacctctttgttttctttccctcttcttccccctccctcgccccccccccccgcaataaaaacataattacgggctttataaaaaaaaaaaaaaaaaaaggcaaattatggtgacatgctttaattatctgccgagcaatggtgggctgaattacacaggcagggccttggaggttacctaaaaataaagcaagaagcctcattaaatgctaattgccacttttgccaactgaagtgagatttgggcaccatgtgccattcagtgccaggctgtctgcagcgaggtccaaggcctgggaagctcagagtgccagggccaagcctggctgggcacccagggcagtgcagggcagatactaggggcagagagaagttctcgatgccagggagagtgccccaatctccccaggatgttgagtggggagatggaaatccaggctgggaggaggaagcctcaggcctcagagcatccaagagaaagggcccacggcctgtcctctgcctagagaggagccacagagcctcctggaagttgagcatcttcctgtgggctcctgacgactgctcctcggacctggaggccgagatggtgtgggggcctccaaatgttcttggtataaaaacaatcatgcgctacatggtgctaacaggccactttctggtcccctttgcctctgcctctggggcttgagaaagcaggatagaaaagcaggttttgagacattggaaaccaccctccccccatgagctggaagagacccaagctggtatatcacccctcaagctaataccccagggaactaggagttccatgaaggtgtgtcctgtgtgccccactgacccggtagcttggtggcctcctgcccggggctggtagcagcccagtcttggctttgggccccaaaaactctttagtgggcattgttccctcttggctgcagaaaccccaaagtctggtaccacatctgtcccattcagtactgcgtacctggggcctggcctgcagtaggtacttaatacctgttgaatggatggctaaacatgaggtctgacagggtggccaatttgtctagtttttccaggactttcctggttttagcactgaaggtctggcatcccaggaactctgctacccatccccaaaccctagtcccttgatgaccctaggcctgaatgccacctcctcccaccccccaaacacacttccaccatacacgttggccttcttacactcagtttgaagtagtggtcctcaaccttgggcttgcatcgcagggacatggaaggcctacaagacagagtgcagacagcacccccaaagcttccaattcagcaggtctggggcagggcccataatttgcttttctaacaagttcccagagatgctgattctgatttaaagaaagaggtctggtgttagaacagcttgaaagccactgatttacctggcctgctgcatggcccacacctagggagcttgtaaaaggtgttgtccccagcccacccccaaaggagactgcagccctgggtagccaccacaactacctctgggtctctcccggggagcctgaggagaccggatcatccctcatacagaacaaaggtctctggggggcaccagccctctctccaaggagcctggagccctgcaaccccacctccccacccccagctatcttactgaagtataaaattctgaagaccctactcatctgtccacctctcctaggtgtcccgcatgagcccgggggactaatagcagggcatagggagtaaaggggagcagccgtgggtctttcccacccatgcatcagaataggtcccacccaggcctccctgtgggatcccagccctggcttcactggccaggccttctgggtgatgggtggcacccaccctcccacactgctatagcacgtctgactcccagaagtcctggggagactggtccttcccctctccctacctcagacccatggagcctgcacacctctctagagccccctgacatagccacttagggttcacaccccacccttggctccccgcttaacccacactattctcataattatgttactttgggatagtcagcatttctgggtggtgggaatatgctgggggccgttgtctctcccatcagactggaagctccgtgagggagaggctgtgtttctccccttagggcagtccttgaaggtggggctgtgtctgctccatctgactggcacccccttgagggcagggcctgtgtgcttcctcccctttcttcctacccctttcttagagtcccagacaggctggatgaggccaaggctcaggaatgcctctcccagctctaggtgctgaggggagcagaggaagcagcaccctccctggaaagagggtgattctccccgccggagcctagaataggggctccacggatgtggggagggcccctaggaaagtcctgggctgaacagcaaaccctgcgcctagctttgggcctcagcagggcaatcaccttgaggggaaacagaccagaggggggacaaggtgcccaggctgaggatgccacactccccttctccatccgagccaccccccagggcgcacacgcgctgcccggggagctcctggcaaacacccctggtctgacaacctagttttgcctgactgggctggagcaccggctacaatctattctggggtgtagtcttaggaactgtcctgcgaaagcaagaccaacagtgagaaacaggctcttcccccctccttcccttacaaatactgactgagcggaacgcagctgctctacacacacgcagtctcacagaccctccaggggaacagatttcctgagcagaggtgcgtgtgacacccatcctcccccaggagtacgatgggctcagccaggggcactaccagaggcacaatccagtgcaccagcctcacctctacacactcccccacacccagtcccagcctggctcccacccggagggggggggtccccacacacactcctccgcacttcagtcagctggcctgggaggtgggcaggggtgcggggctgggggtgggggcgccaggaaggggcgggccaggaagcctgggcttcagctgctgcctgtggcctcattgtgtcaccggctctgtaatttacccctggcagggcccagcccctccactgcttccccttccccacctcccaacctgccaaggacgccagctgctgtgaatgcacactggcacacttgccgccggccagtgacagccatcctcacgatgtgggtgcagtgtggacaagcccccctccattgggcctaaacagacattcacgctacacagacaagcacacctatggaggtgccaggagcagacatgcagccaaaatagacacccacacctgtgtcacacccctggctcacatggacacacgctacactccaggctccaggacagacacacattgtctcagcacctgtaacctggggacaggacaggcagcaggggagccctggaagccaatttctcaagaggagaggctcaggttagaggctgcgggtccaagtcccgttgtgaggagtgagagtcaggggagaggcagggcagaaatggtaccttcctcaagggctgcagggcaggggacaggaatagaacacccccccttacttagggaacctccaggggcagatttctggaatctgttgcaaagccctggtccctccctgcctggggcctctccatgctcccactccctgccagccccggaggcagcctctaccaccccaaagccctaggtctccatcacccactttctccttgcctccaattccaggctctcctgctgaaggttgagacaggggtccccctgcagcacccccagtggatgtggagccagggtgcaaaaccatgtgtttatttttattagaaatgttcttggtataaaaacaatcatgcgctacacattgtcatcaataaccatcaccagacacccaggcactgaactccatgtcatcagcaggaggggcaggcgggcaggcgggcaggactcacggcagacaggcgagggcaggcgggcaggctgcgggccacagggacatacacaaaggccaccgggaggacgcggcacttcgcaacacactcgagatttgtttttgttttggcttttttgtgttttgaaatttttttccttttttttttctctttcgccacaagtaagagtttgtgaattggaagacagtggcagggaagagagcaaaggctggatgtaatgaaggcgaggagggggccgaggacaggaaagaaaaatgcacgagagacccgggtagagcacaagagaaaaaactggagaggcctggagacggaggatgcacaagggagacggggcagaggcagaaaggaaagaagatagggaaaagcagagcacacaaacaggtggagacacagcgaggaaaggcagtgataaagacagggatggagacagactgggacggtcaccagtggaacaggcagagacaaagggagggtgagaaaaccagcattggggcccactcggtcggagcccctgtgatctggggctgggaggggccgtggtccaagatgcaggctcttggggtggcctgaagctgccctggccccttgtcctcctcctgtcacctgaccagcttgcccaggctgcccagcagtgaccgctgggggctctgctgtcctcagcaccaagccacgtccgtgggcgctcacgggcaggcaagacatcagctgggcccctgggagtggccctggcccgacgtgtcagccacaagggtctcgggtcctcctcctcttgttcggctctggcggcctagctagattgcatggttggtgtaggtgacgtaggtctgtttggtggccagtgctggaaggagagagaccgggggtacccaggtatcaggggctggcttcttcaaacacccccttccacacgggcactgccctgcccatggcatcaagtccagattccaaaagcaagcagttcacagcccctcaaactgcatggtggccccccacccatcccattgcttccccctgctgccctcctcccaccctgggtccccacccccagcaccaagttcccctatccctggactcgcccagtctctgaacatccttcccacctccacacctttgctggggctttagttggaacatcccccctttgaggactccctctcaaccctgctgcattggtagggtcccccaaaacccaacccccagtgaagcccctgccacctcccgactccaccacactcgaggagaatcatttttatttgatatatatagccttaaggtattatcaacagaagtttttcaggtcaacagcacacattctggaagagcacatgcgaagaacagacatgatacgtggcctggcagcctaggggaagggagtagccagctgggacagagggaatgaatgatggaaccagagtggggggctttgcgaggctagacaccaactagttgaccagccgggccctctgactaactcagcctccacccctcactcaaggaaggcggaaggcctccaggttccatcaggcctcagtgtggccaacttcccatttctgagtgcccctgtctccccccagccttgagtctcccctctctgcagccgtcggctctggccctcactcagccaccactgggaccagggctgcatgtctgggtaccccttgtttcccggcctcggccccctggggccctcctcctcccacccccacagctgggtgacaatgtcaactcttctgggaagcacgagtctcctctacctccatatggctggggctcaggcctcacagcagcttactgacaaggccaggtaagtgccaccctcctgtgacaaatgaggcactgagaggccagaggggtgaggaccctggccaggtccttggttttgtcctgtccacacccagagtttccctgcatggcccaggacagctcagtggagacaggattgctgcctggggtggaagctgggggctgagtgccggtgtgcagaggaagctgggtgggagacagtcctggcgcaaaactgccctgacgctccatcaagggcctgtctactcagaaaaggagtgcatccaccaggcttggccagggacaccaaggggaacagtatggcaggctccggtcccctttaccccatttttgctggacgcaggacagcagttaaggctgcatttcccacactccccacttgatgacattcctgctaatggcatgtgagtgaaagggctgtgtgcaaccagcatgtcatttgataaaaacaacctgtttctcctatacttcctctcttctgccttctgtgagcagaacagacacagagtgaccagcctcagcacaaccccctgggagctgacggagcaagatgaagaaacccggttcctgatcctgctcacccactgcacccgtgtagctggaagcccaccaacataggcagggtgctgggcccaactcccagagggcccatcaagtgtggccagaagcaaacttgtcggggtggggtgagcagaggggtacaacgtagggccaatggggcagcacaggggtggcatggagtccaggtgcactaaaggaagaactttctcctgcgtggagagggtggccctgtgtggtggctcagttccctacttgaaatattcaagcagaacatgaacaatcacttggctgggcagcagccaggaagttgcgagtctgcggtgccacccggataggtacaatgggaggagacgggcgctgcgacttcagaagagggtaagagcccggcacctcacagtgtgccaagacgtgcccccttcgtttctaaaatgacccatgtgcctccagggtgccagctgaccgggagggaagaaggaccatggacggggctgtttttgagaggggagcacccagaaggggactgggctggcacacttgggcacaggagccaggccacgagggtagaggtgctgaaagggaggcgggagagtgcacagatcagcactctggggacagaagcctctagctccctccctctgtgacctctggcagctcctgccctgccaggcctcagtttccccacccacgacatgagagcacccttttttgcccagacttctttccccaaggggctccccacagccccacatctccaccctgctctctccagcgcggtcagaaaaagagccggctctgtgaatcacgagctgcaggccaggccggtgagaatcagttccccagggctccatcaccccctgggtgaactgataaaatggagtttccaaacctgtaaagccgtcagcagctgtggctcagaggtgaaggaacactgcagcagaagcagcaaaacctccaccagctgcagggcaacgggcacccgagggcaggggcatcgaggcaggcaggcaggaggagacaaagtggtgaggaggtgtgggacacttgggccctgctgtccctctaagaccagagctgtctccaacagaaaatccagtccttgggttccagaacctggaagcgcattcggccctcagctacaagccaggggccccagagtccttcagcggagcttcggtctcaccatctggaaaatgggagcagtgagtctgcccaggccccccgggagctaactgtgaggctccaaaggaagcactctggccgggagtcaggagacttcgggtccaggcctgccttccccagtatgggggatctcagcacctgccaggtggcccttccaatgaattgaacctctcacagcctcgattccctcatctgtaaaatggggtcataaacctggctggctctcagccacagggtggacagagttactcttcaaagcttgtgaagtggtgggcagaggggcagggctgaagtcacagcaataaggacagggtggggagagccacacttcaggggcttccccagcctggagggagggacggggtgtacgagccaagagccccgacccaccccttgccggtgacaggcccctgctggtctgcagtccctgccgcctcagataacaattagccgggcggcagcaagcacaagcggacagcccccatttgttgccctgtgtctttgcgccccatcagcccacaatcgggcccctgaattatttattctgttgtttgtttaaagatacatggcctgccagtgacagagtgaaaaatgtccctgctccacaggagtgacatctccccactcttcctgcttacacccccccagtctggcatccccagaattaatcacctggctcccacccagcacctccacagcccctgttgtcgccaagctaaggaacaggggatgaacgaacctggcctctggttcccactgcagggtggaaggagcaaacagctctcatccttcccttgcagaaagtggggcccggaagactgcatctcccttcactgtgcctccactgccctccttgtctggttaggggcgggtggagtgggaaggggcataatcctaccctgtacccatgtgaccgtgaggtgccatcagagctgccagggaaggacctgccctctggtttcccctggccagtgacagcaccataagtgtcaccctttggggttagggcattatgtccagtgagactcccctcccccatagcccccagagggctaatgctccactctgatgggccctggagcagagctcatttgacagacccactcccgcaccagcagaataaggcatgacagatgaatccaggaaggataaagctccgtgggaaagaggaaaacggcagtcaggagtgtggggtggggagcagtgagggatccctgcttagaacagaagggtctgcttaggggctacatttggggtctctgcagatctagacacaaaaggccagaagaggggagtcctgggaggaccatgccccttcccatctcagagtggaaggcccagggggcacctgaagggagtcccagggctgtaggttcccaagaagctggtggtccgggaggaggagcaggattgaagagaaccagaggtcctctggtagaagatggggcagggaaaaacaccttgtcatcaggatgtcaaagaagggggcatgtcaaagccatgtatcctactccacacagagcatgggactccagagatagggacgccatgtgaagtcggggtcaaaggagagacagtgtggggccagccagccagccaccgccttgctgtgtgacctcaggagagtcactcatcctctctgggcctctgccagggatcaaacctctagccctatcctgacctcacaggacagctgtgaagatcactcaacaaggagaggctttgggagtgaaaaattgtgtgtggatgtaggaagtgactttccttctttccacagatggcagtctctcaacacgtgggggccgtgctaagaaaggaagagaagatgcttccctggagccacaaggcggggagcccatgagaggtgctgcctcagccaacacacaccagggaggccaggtctcctgttctcctgacctcctggcaggtgaccgtgggcctcctctctggagcctgtgttccagaccctcctgtagtctagcccatgtcctcctgctgccatcaacaatgtccatttctggccttctccccaggacaagacggaagagctgagtgctaactcccaggtcccgctgatggaaagtctggggcgagggggtcttctcctccctccccaccaataagagccccccaggactttcagagagccgaggaggcaggagaagctgccactcaaactatttggacacttggaggatgtccagggagggagccatggtctcagtggggcggggatgaccacagccacccccaccagagcagctggaagtgaggcccatggaggtccaccccacaggcaggagatcccatggctcaccccagggcagaggactccaactctttggaggcggtagggataccactgtggcagtcaagtccagccccgccacctgctggctgtacaacccaggtgagtccctaactttgctgagcctccctttcctcatctgtgttacacagaggataaaaaataacctgccttccaaggtcgctgtgaagatgaacactggtacatggtagtgtgggacacagtcagggttcaagagacagtcgccattattactggtgcccccgaggtctgatctgtccttcacatgccctgcccctctctctttctatctcttctcctcacacaggggaggcttcagggggaccagagacgctggcaaagatggtagtcttggtccctcccatgcacatccctgcccaggcctggaccttaggcctgcccctcagatgccgaggaccccctcaaagcatgactctctactacagaggtgtccttggacaatcccttcaaacaccctgccacctgagaactgaggtgcctgaaagccctccatccaatctactctttcccagacccatcctggggactggcctcctgagtccccatatctcagggccctgatcagggatggccaggctggcaccgggcctccatgcccaggaagcagagaccctccagacaaccccttttcccagagggactgaaaaggcacaggcccagatgtgggtaccagggcagagaaatcccagagtccccttttacccttcatgaaccaggttcccttcatggccttgcccttggcggacagaggtccctggaggggtgcagggagggctacgtggggtgggaccctgaggttctctccaggttaccacgatgggcggggcagaggggcactaacttggtgcctcaaggttctcctgtaactcccactcacctgtggccttagggctctcccgagaccctggaggactaggctcaggaggggcatggccaggttcaggttggagggggaggctggccttctcccagaaggaggccggcctgggtgagccctgaggggaagggggcagggccgggcgctcacctggcgtctcgaggttctcgcagagctcagacttggcctcaccattgggccggaagctgcccttctgcgtgaacttgttggacatggtggcggcggtgacaacagctttgaggctgcgcttgcgcttgggcacattctgctccgggtggaagaggatgatgtagaccttgggcatgtagagcatccccagggacaccgaggcgctcagactcaccgagaccgtcagcgtcgtggtctggatgtacagctggaggcgggcgggggttggtgtcagagagggctccgtccaggcctcaccgcccccagagacaggcacggggggatggacccaggagccccgcgctgggtcccacggacttgggcagaagggagtctgaagggagtcgtggtggagctgggacttcagaccagaatctctggattcaaagcctggccccaccacttccagccgtgtgatcctgggtgagtcccaccctgtgcctccgtctcctcacctgtcacctgggtgtgatgttacagtacttacctcatgacaggacttggtaaatggcgaccgtatgtacaagggccggcacatggtaggtgcctgggaatgctgctcgctgctacatgcagatactgggggtagcgcccctggaagggccctcgggggatcacagggccaggagtgagatgagcgtctgctggtgccctggagtaactcccagtggccgtgccacagcccctccaccaggtccccattcagtgactgtgcctcccaccgccaccctgtgcagagccggccactggcacaggagccacagcgcccagccagatatggcgatggcagcacagtcaaagctcatttcacgctcgcgagccagcactaacggtgacagatgtttagcaaaatgaaagtccattaatctgggtgtcggataatccattcttcaatagtggggccttccaggcagggcctgacaattcccactgcccccacccccgcccctccccgcctcctccctccttcctagttctccaagcctctgctgtccctccagcactcctccccaccagcctgtgggaggtcagaggtggccaggctgtggcccccaggtccaggcatggagagggcaggaaatgctcagcttcctaaatctgctgtttctaggcctgggccccctcctgtggggcctggctgaggtgccacctcctgtaggacgctctccctgacccgcagctctatccaaccctctatgacccccattctcatattccacccatctcctgcccttctccagaaatgcttcatgacctggatctgaaggctatcattctggctaccctttgggagagaggctggagaagctctagggtctgaaaggagggaggggtgtgatcctgagcaagtctcaagccctctctggccctcagttttctcatcaatacaatgggatgataactgctacctctcccaacccacaaggtcacccaaacccagactgtgaagctctgtgaacttgcacagcaccatggggaaggaggctgggactgtggagaggctatttcatttgtcaccattcagaaaatgtcatgggcccagggaaatgacagcctggtccccaggctggaggagtaggcagggggacaggttccacaccactggggaaaataatgaaggtctgggctaatcaagatgaggcttgttttctggatcttcaccattggatggggagctccctgggtgagggtatatgtctccctcattagattgggtgttccctaagggcaagggcaatctctcctgttacacatgggttcttgggtacaggagttgcatttccaagtcagatatccagtttaggctctctgtccccaccttgttgattggggggtggggcgtgcagttgggcccatatggagttgatagaaccagggatagaggccccctctctggacagagtgagtcctgcagtggacacagccctgtgctgggcgccagattctactcttccctgacccactgtgggacgctaggcccctccactaacacaggcagagtcagcaccatgggtacacacacttggtttcatgaaacctgaatcttgaatcctgaatcaatcatttttgagcaaggggcctttactcgctttttgcacagcgccctgagaactatggagccagccctgagcatggaaaagaggacaatctttggtgttcttttttgctttttcagcctaggaccctttctgcaaataaaataaaagatggggtatcaacagatcaaacccaagcaaagctgcccccatcttctggggccctgcccttccagcatgagcctcgggggctcttctagccatcacacatgcatatacatggatgtgggggtctctccttgctctgagcactggaagtcccaccacaccaccggctcaggcattagagcccctgtgtgaaggtgcatgttgtcaccaggaggtagtagcgtgccgattctatcaaagaagcagtggtcctctagagccactagaacccggcaggtacctcctgccccctaggaatggggcccaggcacacatgcagctctgcaaggcaggtggggtgagaggcgacctccaggatgtgatttcatcttgtttcccaaccacccatcttccagacagaggtgtctgaactcctgctcccatctctgattaggccaggcctgcctgctacactctgtcctctgcaagaaatcctgtcttagcctcaccagtgagtgctcctcaaggtgaaagaggttgtcagagctaggtctgatgggtgtggatagaggtcaccgtaggtggggcaaagggcagagtccgaggggccctgttgggggcacagaggagtcctgacggctccatgcttctgtccaggtggacccaagtggctactaagatccccagaatctccgcaaaccggatgaatgaacttccccacaagctggtcagcctgtggccaggtcccgctcaagtccagctgagccgtaaccccacgcggtagagaaaggacgctccagacggctcagagtaatgcctcgcggcagcagcgacaacccctgaaaatccggactaaggcagggaaatccatcctcctgctcaccagagcaggcttcactctgcgccaccatctgcacgcttggggaaatgggtgcagctgagcccctgaaagtgcaggtgcgcacacacctgggcatacccacatgcccacaaacacacacacccatctacgcatgcatctctgcattcacacacacacctgaactcacagctatacactcatacctaactcagaatcatacttgggcatgcgcgtgcacacacacacaacacattctccttcacacacactcacgtgcatacacacagatacattcacccacatctccacacattactgaatatgcatatacaagcgcatacacacatctgcagacaccgctgggcacacacaactcgtctgcacacccacaccagcagccatgaacctctcagcatacacacctgcccatccccactcaatgtgcacacatgcgcccacctgcacacagatccacataccacccagccacccctgaacatgcacaaaaaggcacacacacctctctaagcctaccacaactccccacagcaaccgcacccactctatctacacacacacacacaccagccaggcctacagcttccaatgcccacagcattttatagtgctacagaacatgcacagatacacccccagggctgcctttgcctcctcactcagaagcccgggaggcaggtccacgtccccccaccccagtggggggcagagcagggccttatggccacacgttgctgtgaggctggcctgctgtgtgaccccaggcaagtaagcctctgcccctttctgagcttcagaggagatcatttcagaggcttcctttcagaatcaatactgagcggagcctcctaaaaagggagaagtcagaggcaggcctgggcgccaggagagatgtgggggctgggagggagggagggcccggcagctggagtaggtgggtgtgacaccctgggggggggggggggcagggcagcaggatgctggcggtagcccgaggaaactaccagaagcagtataaggggctgctaccaagctgtgggccttccagccaggtacctttcctccctgaggaaccaagggaaggggcgtcctgtcattgctgaggctcgtttctcaagctggagtagggatggcttctctggtgggctctatgggcccccccacccctacactgcgggccaaggggcttctgcctgcatctgtcctcaccagggcgggccccccacaggccctgggtgcaggagccctggctcatagtgtgagctgggcctggtggctgctttggctcagggcactcactgccaaccccaacgtccgcttctccgaagccctcagcccacaggcctccctgagccaggccaagagtttcagaacaagagcacagctcctgcctcgagttgctgcggcagaagaggtagcacctccaaaggaagccccagggcaggaaggtgtcccagggctgcagggacagtgtgcactaggcttggggtggggggctcctgaggtaggccagcagggtcaagttcagccgtgcccctaccggcggagtgatctcaaacaagtcacttggcctctctgtgcctgtgtcctcccctaaatggggacagtgatccctacccctaccctgctacagcggagcctgctggccagtaggtagtgcatcaggcacatgacaagcaccccacccatcgtggctttggcagcagcctcactgaaggccatgcatccccggtagttcacacctgggcgggctctgcttcggatgctgtccatgggctgaagaccccccagcaacatatccagcccgggctgcttgccctcggcccccaaacaggctcctctagtgtcttccccgccttaggacgcagacattccttccttccgatcctcacaccaaaaaccatggaatatcattcttgatcctctgtacttcttaccccacatgcaatccatccagaatccagccagcccacctgcagacacatccaggagcccccacttctcatcacccctgccgccagcagccccttggtggggtccctacaggcaccaccacattggccgtccagctcccagctcgccttccacagggccccacccagcagccagagggatccttctagacctgagctatgtcacattcctcactgttcagaaccccgtggtggctcccttctcaccgacagtaggagccaggatccttcccacagcctctgtgtcttccagcatctgccctgtcatccttctgaccctgcctctgtcaccctctgggttcctcagccctgggcctccctgcattgggcaaactgttttcatgcccatcatgccatgtgactgttacaacaccttaaggattgctagagaagaatcatggccctaatacactaatgaggaaactgaggcagagaggccagctggcttgctcaggatcatgtggagctcagaccaggcgctggggtcctttgtccccacaattctcccctgtttctagcctctggcttcagtgactcccagtccttcaagataaaaccacacgggggcacccggggcaccactcaggggctgagtgtctgccttcggctcagcgggtgatcccaggtcctgggattgagtcccacatcaggctcccctgcacggagcctgcttctccctctgcctgtgtctctgcctctctctatgtgtctctcatgaataaatgaattttaaaatctttaaaaaaaagaaaaaaataggtaagacccccccccccccgcccccgccagaagccaggcagtgctggggctgggatatgggcagagtgcacagggccccagggtgcatccaggcccatgggatggcctgacagagccagcaggaggcagcccctctgcagctctgggccggtggaaggaaggagcctcagctgacaccccaggctcccgggcttcggaggcttggggacgaggagagaaggagacagtgtcggatccatcccccaccagggacccatggggatcctatcctgtgaggacagagagaggggcagacagaagatgaggaagagaggagtggatggcaaggctgatggggctgagtagggagagaggtgagggagagtctagaagagagggaaggctgacagaggagagaggaagaggatgggaggcagaggcagggagggaaagagagaggaggacagaaggagagggggaagggaggaggaaggaaagagatgagatggtggggaaggtaagctggaaaagaggaggggcgactcagagattggagaacagactggaggcagaggaggcagtgaggcgtgggagaaggcatctccagagcaggtgcgaggccagggagccccagaggctgcccccagctcagggccctcactcacccacccccaccctggcgccatcactcaccttgtctgccgactgcgaggtgccaaagaagatggggatgaaggcgagccagacgatgcaggtggtgtacatggtgaagccaatgggcttggcctcgttgaaggtctcgggcacaccgcgcgtcttaatggcgtacacggtgcacgtgaccatgagcagcatgctgtagcccagcaggcagatgagcgacaggtctgagatgtcgcacttgagcacgcccctggcaaagcgggggtcgagcgtccgctggtcctggaagtctaccaccgagtgggaggggtccaccacaaaccacacacagatgccgagcagctgcagggagatgaggctgaaggtgatggccagctgtgaggcagggctgatgaagcgcggagcactgaccgaccgcttgccctgctcgaagattcggtagatgcggttggtcttggtgagcagggccgcatagctgatgctcatgcccagccccaggaagatccggcgcagagagcaggtccccaggtcaggctcagcgatcatgaggaaggtggtggcgtagcacaggaagatgccggccagcagcacgtagctcagctcacggcctgaggccttgacgatgggtgtgtcattgtagcgcacgaaggtgaccaccacgaaaagtgtggcagcgatgcccaccaccgccaggaagaggggcagcacagcccaaggcgagtcccactcaagcttgatgatggggatgggccggcagcccgtgcggttctccgtgggccgcatgtcatacggacaggtcttacaggtgtagcgatccacctgatactggtaccccgtgcagggctcacagtgccagcagcagggcatgcccttcactgtcttcttccgctcacccggctggcagggcaggctgcagatggagcggggcagctgctgcccactccctggccagtgcatccgctctatctggcaacgacagcacaggggagctagccttaggatacgccgtccagtgccttgggctaccctcctggctggcaccctggggccccacacctccatcacctggttaggtggttaaaatccagctgtccttcccaaccatgagctgctgcatccaacagctggatttaaataagcccacccacatgacttagacacggcatctggaccaaacccgaaaccctcaaggaccatatggagacagcaagcccagagagcagcagtgacaacccagagtcacatggggaagcagaggggactcaggagctctgaccccagatcagcatcagcatcacccaggggcttgagggaaatgccacattttggccgaccccagaccttctgtttcaggatctgagttataagtaggccctgcaggtgaccatgctggagatgcgctgccccacaattcagaccatggggtctcctctgggcagcccaggaatctgagctcagcagggagcaatgaacagaagtttatgccgaggatacataatctgtgcccaggggttagggtttctttatattgtgctctaaattagtgctagtcaccgttacatgtctccaaagacacaatcgctgtgagcaaaggagccacaggcatgttggcacaccctactgaattcaatgttagagaagcctggaaagtaagaaaagttcagggaagtagcttatcctgtggctctgggcacgacaaggccatgtggtcccctagaagccaaagagcacagcaacaaccagggccaccatcctgtaggaacagtgaggctggacaacccccatgcacgggagctatgagaccacaagggacacagcgcgatggtagctgttctggaaaactctggctcccgggagaagagccgcgaatgcaggcagaccctgcgatcacagatgtgttgctagctggctgcaagccctgcagcaaacatctcaacccttccaagcttttgtgttctcacctgaccaaagggcagcagatatgaggccactttgccctttgctgcttattgtaccactgctattgtggcttcctctggcaagtcaaagcagaaactctgaatatttccccagaatggctctgtgcgtgttccctgccgcgtgtctggcgcccagcacagggctggcacacagagggcccagggaatctctgcggaatctgtgatagaggtagtgagtcccaagcaccagccacgagaggccaccttgctctcagaccctggaggaagatagcagcaggcggggcgaagtctcctcctcagcgccccctatcccagcctggcctactcagtggaccccaaactgagccctcaggagaaagtggggagggtatgagggctgaagcccagttctccctaaccctccccaccctcactgccccaatccatgctggcagaggggcctcgtatcatcagggaggagtccgctgtgcaccccacaccgaggccctgctttcacttaccacatctgtagaatgagacaagaatagtacctgcctcgcagggctgccgtccacacagtaaggtcacatgcttacaagggtccctgtacacagcaggtactcagtaagcattaactgccgatgccgctagtcaactgaatcacaggcccccaccgctcctcccactgcacccaaaagagacacgcctccacctggggtatcgcctcacttggcaaagtgagtctccgttcagcagcccagggagcatcacgacaagaacaggttcggcccctgccctgctacttggccttcagaacatccctcaggctgggcttgcagagatagttcctttgacttagaagatcatcggagctaaatgggatcatgggcagaaagggctttgaggagttcaagaggttcgccgctggaacagattcttacaagaggggagagcagggacacgatgcaactctcccaggatctggctctagggtagctgtggccagacatgggcctgggcctcctgagtcttctggtccatccctctgactgtcacactgtgcccaccccaagcttggctcgccctgccaccaaggcaggggccaagtccactggcatttcctcggggaatgaaccacaggtcctcgctctccaaacacctggctctgttcaccgctgggtacactgaaggagagggagaaccaccttgtccctgggacgatcacgggctgggaagatgtcgctaagaggacccaggagaagaccccccacacccacccagctgccccaaaacccagaaaaatgatgaccttctgggtgcactttgacagctttaagaaacgctctcgaacaatactgtgccctttgccttaggccactgtcctccttcgccccatggcagcccctccccacccctactcacctagcttcccgacccctgctgagccgccaaggccctgttcctccatttcaggcaggagtggtgcccagggccctcagaagccagagtacggcacggaaggaagccccaacctggcagcagcgcacctgggctcagggctgacccagactgatcgggggctgcctcccaggggctgggtggcacgagtgactctctccatccctccaggggcccttccctgccctcctgctgggcacttactctgaggtgcaggtggtcagtccaggagccgatgaccttatactcagcagagccattgcgcaactggtactggtagatgtcatagcgcccaggggcgtctccgttctcattgaaggtcacagggttccctgcgatgcctggaggggccggtgagggtcacacactcagtatattggctgagcttttactgagaagcagggagtaccacgaggccagtgcagagacccctcgggggaggctcctgcatggaacatgccctggaaacatctgaggagaccgccccccacacactcctaccctacggagccccaggaccccttcccctgggcttcaaggcccgggacgctcacctgagaagttgacactgcggatgtacttgagcagttgggtgccatccacggggtccatgcgggggcagagacccacgcggccgggacacaggtcacggtgcatggcgtgcagcgcatggcccatggcatacacagcatcgatcacaaactgcaccttcccctcctgctcatatgctgagtcctgcccaatgcgttctcggtctgcaatgaaacgcgcaaggcgggggcaaccatgaggctcaccgtcctcacagaccatgtggcagggaccagagacgagagaggtgacacagcccgtgtctgcacacttgggcctcctggctcctagcccagggcttgctctgccacacaggagatggtcttatggaggcacacgggggcacaattccaaaaggtgaaggggagggtccactaccctcaccacggtactgccagaccctatcctctgaggccccagaacagccagggcaggtccccgtgtcacaatcgccttcagaaggcaatcggccagggggtttccctgtggctgtggcctccctgctatcccccagcctggcctagactaatctgggagcagctggcccccgcacaggctgggaaatcgccaggacaaaagctatgtcttgcagtggtaccctatggcagcccactgatgggcagccgctccagccatgggacagatggggaaattaaggcccagagagggtgagagcctggctgcagatcccaggacacctggtgccctcaatggcttccagtcaccctggacaccagaagtcaccagcatccccacccactccatctccattagccaggctgagtgagatttgccaagtggggaaccactcccacctctaccctcaccttgctgcaaatggcagtagctccccagggcagcatggtcttggggctctggtctcctacccttactccctgggcccaagctccttggctgcctaaagcttcagtgtcctctagtaaaaaggggatcataatcctgctccacagaggcttacatgagaagaggtacagaaaacacttggcactgaggtgactaatccaagtggtcagagtggggggtttctgaggtccctgagccagagcaggccaggaaggctttctggaggaggaggcactacctgagcctgggccagggtagcaatcataaggaagaataagggttgctaacttctagcgagtacctgccctatgctcagcatcattctaagctctttatgcatatcaactcattgaagtctcaccagggtgctaggaggtgagcagttatccccataccagagaggaaactgaggcacagaaaagcccagtgacattccagaaccacgaaatgccgattctgaacccaggcacgctggctcccagcctgggcaccactctatgcctgagggattctaagagcgggattgggcggcggacaggaaagcagggaggttgagaggaggaggggacaggaggtggctgcaaagtggagggaggcagaggatggccagaatgccagagaagcctggcttcgctcctgaggccacagaccctgcccacatcacaacctggaacctcctccctggagaccaggacagagaagcccggccacaacaaccaccgcctctgtgccagagggccagtgccacaccttgcagaggtgattccccagcgggcagcaggataagtggctgcaccccagcctagccccatgggccacagtctgagcctctcatgtctactgtgtgggggccaggccgggctgggtcagccccaggccctgctcccctgggaactccaaaggtcactctgtccctccctctcccttggatacctcggaagcaaacaccgggtaaagggaaacacactgctgtccccaggctctctctaccatctaatcctctcaccccggaaggacagatgccaccccacccagatgtggggatggctgggctatgcatcagtcacccctcaactggccaggtcaggtggccaggaccccaccccattctcagctttgctcagggttgagattcaacacttgctgaatggacagcagaaatcatgggatcatagtgctaggaacaacaagaccaaggcaggtcatctgttccaattctgctattttacagatgacaaaactgcctgcccagggctcctgcagagctgggggcacatttcgtatccctgccttggccaccaagactgaccaagggcagaacttgaccccagtcaccccaacctcggggatcagagatcaacaagagtcactagtactcagattgcacagctggggggcagatgcccacttagctcgaggcgggggggggggcaccgttcagtccagacagggccccagctcctccagggtggccttggggctggaagcaggccaggcttcggagctgcctcaccggctctctcctggtcaccaaaggccctcgctacctgctgtcactgtcctctgtgtgcaggagcctggacttgagtccagactgtctgggctggaaccccagctctaccacccactctagctgtgtgtgaccttggacctgtcactccatctctcagacttcagtcctctcaactgcaaaatggggacagtgatggtactgatcccagagggtcaggattaataggttagtatgtacaagacctgaagagaggcgtggtgcttcccaagtgctacagaggttggttaaatctttgcacctgagggcacagagaggtgtgagtcctgccttgcctcagagctcctgggccagcagagccttgctaacaggcagcattatttctaggccaaggagcaaacaagaatgaacatgaaaggcaagtactccagctttccagcctgcccttgtgtctgagcttctgatgacaaggttctgagaaccagaagagaagcacagggatgatcctgtccccaaagggagggcagttggcgggggagggtcctagagcaggattgcctggaaagctccagccctggaccctaaggggacctgctccactgagcctgaagaatggaagacataaaatcccactcaacaacccacattcccatcacaccttcatttcatctgggtgagagactaaattattaaccaggacggagggaaggttgtggccactaaagcaagctggcagctctctcccaaagccaaggacacatggggctaaggggatctggctgcaccaccccagctaaactgccctcacctctcctctctcctcctccaagggtccctcctcagggggaccagctgaagcatccattcctgggccactttggtccaggacaagtgccctcgctggggtcacgagccgcctgcaccaacaccagattgaggaccaccctcactgggagaagccagctctggctggggaagctcccactaaaggggctctgggctcctgtggagctgtcattgccccctcagcgcagcccctccagaatctctaccccagagctgtcacagtgccagccacagactcctagagacttctcgacacacccgcacatccttgacttttgtctcacgtccagccccaatgacagatgagaaaatgtgcagcaaggcggcttgcaaaggacctttattttcaagggtaccccaggcctcaagcatgtcctctacacacaggcacccctcaaaccccaagggcccttcccctgcaccccttggaaggcaataatgagagggcctaagtggctcacatggtggggggcggggagcaggaatcataaatacaagttaaaaaggacaagatgctccatcctgaatgtctgaagctgtgccagtaaccagcgcagctctccacgttcctcctgattcctcagcaaataaccttttggcgtagctgctgctcaccgagaaccttcacatgcctggcattttctgttctgggaggctctgggaggtaggcaggctaaactggcccctctcacagaggaggtaactgaggtgtgcgagtggccgagtgatgtaccagaatcttacggaatcctggcacctggcatgtgctcctacgtccctggggattggcctggctgggaagtggctgagcagggatttgaacccggatctctctagttccataagagttttccaccacctgtaccatccctctcctacttcttccacccagcctctaacctgcctccttccccttttctggggtccaggctcaaccaggagttaaggatccctgtctgtggggctaaagcaggtggtagccgtggagaaaagtggggatcagaaaaatcccctcatgggtgggcaagaccttcagaaggtccaggtggctctggaaggaagcatgacacacacccctgagagccactgtaggagataaatcccagacatacggtggcaatgaccgcagcaacagtttgaagatgtcctaattgtgtcccggggtacagtgagccagggatgcgtttggctctgccacaggtgacagccagtgggggaaactattgggagaggattttcttcgtcaaaaccctgcagctatggttactacagtgactgcagcctttgtaagcaggttgtaaattgtaattgaaatgagttttcaaggttgaaataatcagagtgcctccttgtctctctcccatcacccgccacgactcaccccgcccaactcaccctgcccaaccgcaaccctccggagttctacgctccctacccacgcacgcacccagttctcgaagcggttccctcacataaaggaatatgaaatccattacgtacgcacgcacgtatattcacatccacccatccagggtggctgcacgcaaacctgcaggcgttgatacacatgtctaaacacacacccatgttcaaacacagataatcacaagtatatgtataaacacgggtaacacatacatcgctacacaactagcatggcactcatccaaacacagggtcatccagagtcacccactgttgggctgagatgctcacaagtgttttctttgggaagtgatacctggaaggaccagtaggggtaggaacctgggatggggaagggcggccactgatgccaggtgtgcggctccatccctctggggccctccaggagaccatgtagaggacgcctcagggctgcccatctgaggagacaaccactcccgctcccaccaatcttaggccaaggcctgcttccaagggcactaactgcactggcaaagacggggctggtgagcactgcagggaccagggagtggcagcgtgtctgtattcacaggtagaggcccacatgtgcaatccagcataggtgcacgtacacacatctgcacacagaagcttgcatttacatacaatatacaaacgtacacaccagctttcatctcttgggcaacttccggggagtaggataagagggtcccagggtccccccaggaacagcagcctagcaaatagctgtgcctgtctcccagcctgccacggaccagctagtgatatgacctaggtcaagcaaaatgcacattcctcagatgtaaatggggggtaataatactggcctgcagggcccctcagaggattagggaggtacaggtacaacacacagcatcataccttctatacagaagcactttataaacttgtttcctctcctcccaggcactcctccacgggataagatcccacatcccgggcctccctgctccatcctgcgtggtgcatacaggccctcctaccctcaggatgacgtgagcacagggtacccgaccccatgcagaccggggcccagctgaggtccgcccgccgagatctagattcgaggacaaagctgccacactgtccttcctggccattccccttctttcccgactcaccggtggttgatccatcctccccaatatctccctgaaacacccaagtcttggcaagcgataaatgccatataactattagctgttattatcattggtggtggtggtgtggatgctggcacaggctgggcgacaggaatcccccacacatcctcagctgccatgcacccaccctccctctcagagctcccagcccctgtgaacagaaggcagtaaatttttcctatttcctcataaaccgggccttcctccgctcagccatcacctggctggcagtgctgtcaaaaagatggatgccacatctgccttgtttacagctttaattcccaaaccctctctgcatgctcccagggagggggccaggagacagagagggaggcaggtgctgcccctccctgggccttgacagctgcaagcctccccctcagtgactccttcctggctcaggtgtggggggagtccctgggcaatctgcaggtgcttcccacagatcacctccatcccttctccgggaaaaggtgagcaaggtggctctgcagggatggggctctgtggggatgggcgtgggtaataggattcccattttacagatgaggagactgaggcctcaagaggtataaggccctgccgaggtcacacagctaggaggcagcaacagggggattcacacccagctctgcaggaccctgacagcagaatgtgtgtaccctctccctcttaccactttgagacacaccggcccaatctccagctgccagcatctgctgctctttggagactttctgtggtcacagcagctctctgcccagccatccggcaggcaggctggaggcgctgaggaattagcatcctccaggagcagcctgtggaagcaacaggcagaggccaactgtgcaatctgctggcctcaaggggaccagagtgggccagtacaaggccaccagtgcagatgggcaggcctcctggaagaagtgagtgggaagccaggctgggagatagagcaggggtaggtggagaacacagagcacacctgggctggctggaggcaagagggggtgcctgggagagcaggagggcaggaaatcggagattgggcagagcaccagccctagagccaggctgcctggggataaagccagttctgccaattctggtgccgtgatgttctcaaatggcctctgcagcctcttctgcaaaatgggtgctgcacctgcaacagcctctaccaactgccctccctcatcctggatcctacagctgacatgcaacaccagtaccaacagatctggcaatcccatcactcccactccctatccacatcaacaaccattttaccagcaccgatcatgcacatcatctttcagccagcctcttcctacccttcacctccaatcctcacggcagcccactgagatgggcagtgactcccatcttctctgagacgcagagaggttaaatgacttgtccaaggtcacacagcagggaggacacggagtcagatccaggcccggggctgcatccttctcctgccccccaccaggtgcccagtgcagagccagccccccaccacttcccgtgggtgtcaccctggccctcctgcctaagacactctcccaagggagtggctcagctcaaacctggacggggccacgggatgcttgagccgcctccccctcacccggagtgggtctcaggtcccgcacacattcccagcggcagccctgctcctcccgataccctgaggtggacccgataccctgaggtggacccgctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaaaaaaaatcccaatgcccaggttgtactcagtaccaatacacttagaacgtctgggggtcaggcatcagtagctttaaacaatctccaggtgactcactgtgaacaaggcttggggaccacagctcctactatggtcttcagccctgaacacacacaaaatcacccaaggagctttcatgaagtccacagcccagaccccacccctgagattctgactgaacaggtctgggggtggagtgctggcatagttttaacagccacctggtgattctaatgcacagccaggcctgagagccaccattttacagttcacgaagtacctccatccatgctttctcatttccaacccaagacactctctgggctggctcaccatcaatcccattcctccaataagaaagcaaaggcccgaagaggttaaagagcttgcctcaggctcccagcgaagctctacactcctgaactgtgctccagccctccctcctccacctgctctgacagcccaaacacctccctcagggctgcggagagatgcccctgtccccagttcaccagccaggccgaagacatttgtgaatccagaccccaggactgggaatctaggtaaatagagtctacaggagctgatcaaggtcctctcctctcctgcccctcccaaaccaagaagtgactccagaaagccctttgcccttggcaggctggacactggaggccctgttacccatcctgcccccatttccagtctcaccattccccatcctccagccaggtctggggatttataatcagggtgaacatacaattttccatccccacttaggcacttttaagaataaaagggatgtgggacgcctgggtggctcagcagttgagtgtctgcctttggcccagggcatgatcccagactcctaggatcaagtcccacatcaggctccctgcatggagcctgcttctctctctgcctctgtctctgcctctctctttctctctctgtgtctctcatgaataaataaatgaaatcttaaaaataaaagaagaagaagaggaggaggaggaggaggagggatgtttttaggggcacctgggtagcacagttggttaggcatccaactcttggtttgggctcaggtcatgatctcagggtcatgagctcgaaccctgcatcaggctctgtgttcagcttagaatctgcttgagatactctctctctctccctctgccactccagctcatactctaaaacaaataaatcttaaaaaataataaaagagatgttttccaaaattatgtaagatgcatagtcaccctacccatgaaagctcagtctcctgtgctgtcatttttgcatttcttaaatcttcaattactgcctgacaaaggcatttgctgtacagcctttggcaagttgcttggcctctctgactctccagaccctcctctataatatggagatcagaaaagcccttagagctgttataaaagtgaaaaaagtgaaatggggtaatgtgtataaagtgtctggaacacagaagatacacaacagtgagtgatatttatggttattagcttgcctaggaacataagcccccacatcagacaaacacacacaccccttctcccatagacgtactgactcatgtacatacacagtcacacacaccaccatgtacacccacacatgagcttgcctgctgggcccctggggaatacccatgatcctaactagccaatattcctgactcccagaggacccaggccaccagagggcagcacccttcccacctgcctgccaacctcctcaagcttcctcctcctgagttctgtgactcaggaacctaagatcccgcaagccaggccaatggccccttgctcacctggccctctgcccaagccactttaatccgtccaggaggatatgagagggagatcaccatcccctctcgtgaccactcaggttgaaggcacccagagctccctcagtgtcactaagggaaggtcctgctgcaggctacccagatcaagaatatacagggacccacatctgaatgtatccaaatgtggacataccacgatgactaccctaggggacttagggcctggacctgggtccaaatgctgctcaaccaccttccatccatgggaactcagatccttttactttcttgcacctacaaattgttttccaatctgtagaatggacccactgtcccattctcaggtggcccattcctcacccttttcaggactctactcatatgttacctttataggaaagccatctctttgttctagttgtttctagtgtacatttcctttctgatatattgtacagttcactatttatctcgtttaaacgttttcctattaggataaacattcaagagatttttgactcactcattcagcgccatatccacagtgcttagaacagggacgagtataccctaggagtcaaattggtgtttgttgaatgaccaagggaaccgcaagggattagagatggtttctgcaaaatgctctgatgggtgaatgtctggactcccacacggggcagctggggtcaatttcgtgggctcatcccccaaggtggctacaggcaggaggaacctcttgcagagacccaggagcctcctcctgccacaccccacaccccagcagcatccctgatggctgagagcaaggcaactctactgttctaagcctctgccccgcctcggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccatgcagtgagtgtcctgcctggggcagcgttcaggtggagattcagtggctgtcggagctgtaggagaatgctgacattgataagggattagggttagggcagggtttcccaagccgtggcaccattgacagtctgggccctatcattccttgttgtggggggctgtcctgtgcattgtgggatatcgagcagcacccctggcctctacccactagatgccagtagtatcactcccgagttgtgacaaccaaaaatgtctccagactcccttgtctcccttgaggggtcaaatcgctcctctcccctatgagaaccaatgctcaaagtcttctctagtatcatagggagaagggacttgccagacaagttctgggttccaatcccagctatgccacttaataaccatcatatgtcacttcacctctctgagccttaatatattcacttactaaatgtgtataaaagtgtcctgtggggttgctggtaagagtaaatgagatgtctctcaacagccatagtcactactgttttgtgtttaccgtagctcgaggctgagagggataatgtggaaacttctgtggcctgtgtcccctctagctcagggtaaagaacacgctgccctgtgaccttgagcaaatgcctcccgtgctcaggcctccatctctggaaagctcagtagagacggatgtctgcaggccttccccacaatatcaatgctggcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgcgccggttgttgtccgcgtgcggctggagaagtagcggtcgaagcctggcggggaacctgggcatcagggcctcgtgcccccttccctacctgcccccagcccttccagctcccgcatcccccaagggttagagatgcccaggcagagggagggaggaaggcaagagcaagcctctgatccagggcccagctggcaaaaacaaaatgtggagcatttcatttcattcaaaatgaaaagagctgtattaagtcccaggggtagcatgtgtaatcttacaactgctgcctttatggaagagaggtgcgtggggaggatgcttcacgcttggccttttaaccaccaaaatgctaatatccgggctctttgagaagaagccacctgggggtcctgagattagagtagagaggctgttgggggctgaccaaagctgggggcacctgagctctctggttctgaagaggaggccagacaagagagggaaaagggtgacccaggtcacatagcaagaccagggccaggatcttctgcctctgcatccagaacttccccatttctgacagaggcggcttcctcctccagatgttccaaaggagactcccacctctgctctaagtgcagaaaaccccaccccagggtgggcagcctggccaatgaagagtgcctactctctccccacagtgctccttctgcattgatgactgttcccagcaacatgcagagttgactgagctgcttggggtgggcccaaacacctgagagttcagtagggtccatgccatgcagtgagtgtcctgcctggggcagcgttcaggtggagattcagtggctgtcggagctgtaggagaatgctgacattgataagggattagggttagggcagggtttcccaagccgtggcaccattgacagtctgggccctatcattccttgttgtggggggctgtcctgtgcattgtgggatatcgagcagcacccctggcctctacccactagatgccagtagtatcactcccgagttgtgacaaccaaaaatgtctccagactcccttgtctcccttgaggggtcaaatcgctcctctcccctatgagaaccaatgctcaaagtcttctctagtatcatagggagaagggacttgccagacaagttctgggttccaatcccagctatgccacttaataaccatcatatgtcacttcacctctctgagccttaatatattcacttactaaatgtgtataaaagtgtcctgtggggttgctggtaagagtaaatgagatgtctctcaacagccatagtcactactgttttgtgtttaccgtagctcgaggctgagagggataatgtggaaacttctgtggcctgtgtcccctctagctcagggtaaagaacacgctgccctgtgaccttgagcaaatgcctcccgtgctcaggcctccatctcttggaaagctcagtagagacggatgtctgcaggccttccccacaatatcaatgctggcttctatttaccgaagcaagagcaggggagaaggccctgggagcctgcctccccccatggtgagaacagtgaggtccctgccagactgggccactaatgggaacctcacgcctcactcacagagaggttctagtcagagcaggttgttcctacccagggtgattgtgggttctgccccgagaggaagggatgccggacaggacaggcccaagctcaacagcacccagggcctggatctggcaggccctgcacggagaacctgcctccacccccaccccagcacagcatcttcctcttgtctcctgctcccaggcccttttgacagaggactggccccaggcagggagagggccttggctctccgtctcagatgggagaagggatggaggtacgtggggatgaagggaagtccctgataaataaccttcctgtatgtgccacgcatctccacacccagaaatatctgagaaggaggaagaaaacttctgaatctggatttgaatcctgctgggttgagtgtagccagaaaggccacccagcctagacggtcagcaccaaggggatgtggaccaaggaagaggaaggacaggatgtgggaaaatgaggaatggagtagggggacaataaaaagggacagctggggaggatggtggcagcagtcaagagcggtgggcgtgccttgcccagtcctacctcgcacagacatcctcttggggaggatagtgactgcaccctcagccacctcctccaggtgcagcaccggtgtgctcttagagccccagctgtccgagcccatccagaagaagtggcctgtctggttggccttccgtgccgcctctagcacacgcctgtgggaacacacaccagcccagcccagccgtgtctgcccatgccacgaccccaccccagccacacctgctcaggggccgttagctgaccctccccaccccaggcacacacacatccccctcatagcccatgcctgttccaccaggcccatgcttccacctgcatctggcccacaccctcctctggcccagggtgctcccccagacccacttctgcccctagggccacatctgtcctacaaagacaaacccatttccctaggtccgtgcacgccccatatctgacttgcacccccggcaccacatctgcccagtctgtgtcctctcaggctcatgccaccctggtcctgtgtcacagccacatctcttggttcattttcacatctatatgcctgcaaatgcgtacatacacacgcacgtgtgcaaacatacacacactcctctacatggttacccctctgcacctgctgctcccctgccagcagagccctctccagcccacccccttctgtgccaaaagcctgggcctccaaagagctgcttcccagaccctcctgggtagatgaaagggtgagaggcaaccaggtgctcacctcaccccgtccacagtcctactgtgacagtggttgtaatcaaatcaaattggggaccctagagcccagcacagggcggtacccacaggaggcactctggaggagaaaaccagccagaactcccccaacccagctctggggaatgcctcctcagaggaggggaggcagaggggggcagggaggccggaactccaggaggcaagcaccgagctcagaagctcacagtgagggagaggctgtgatactaggaactgggacacggcccccagggcttgggggtgctgcggatcctgggagcctgtgcaggaggcagccgctggggccagacagcccagggctgggggagaaactcgctagcaggccccagagcccacgccttccctcctccagcagctctcgactctccaagtccccaaacccaccctccccagggcacattaatgagggggtgagggggagctgttcccagaagccatgcccacagcctattagtacccgctagcatcaggccagccagagatgaccagagctcccagaccttcctccctgcaaagtcacctgggtttatttttacttctgtttgcttctgaaaatgcatgtggatttcccgaaatgcctctgccccccctccctgcggcattccctctggagtcagcccctcccctaggtacctctgctctgggaggcatggcccagcgccctcatcttcccttcccagcacatgggtccatctgagctaagcaggaggcctggagcagggtgcacttctggatggggtatgggttctgagtcctgggctttgaggtggggataaagataggagtgcagggaccagtaactgaaggagaaggacttctgaagggaacctcctcctccaggagctggtgacctgtggataacaggaatgtcccgatggcagaatttagggggcctgtaggccttgagggggtcaggagcagccctaggctccacagcctctgactcctccctcccagccttgggctgcctgagacgctgcccttagagctggtctcttagccgtttgtggccttaatgatcttccagaacttccccctccatccctgcagggacctggcaatgtctcctgggggaaatctgtccaggatggggtcgtcaccaagtggggaaagggctggaaagaagaggacccagatggacactggttagcaacagggagggaagcacaggggggcaagggcagacaggcagccctggcggagcaggagggcaggggaggctgagggcacagcaggctataacacgtcaggccagccaactgaggggggaggcctggggaggatcacatctactgactcatcctcccccgcaaatgtgggggcctgcctcccccattggactctagcaggggctgtgtgtcccctgagcctggggcttcctgagctcagagcttgcatctctccccttggccaggacaatcacagaggcctggcacatcttggccctgacatcagtctgagaggtagtagcagggaaaaggcaaggcaggaagaagggaagtaggttaagatgggtgctttgatgtgcaccagactcgggaccagaagagatgggctggcccagcactgcatcacatggtcctggcaccctaaagtccacctgtttcctcagcagatgcagagactgaggccagggaggggacgacaccgcccacagagagtgtgcaccagagccaggactaaacccacagcccaggcctcttcccactactccaagctttgccaaagagaagaggcaggggctaacagaggtgggggtggtggggactccacacgccccaggcacttgcttggagcctgactttaagccctttaagcacattcctgcattcagttctcaaataacactaccaggcttgcatccttagcacctccctcctttttttaaagcagaaaagaggcacagagaggttgagaaacttgcctcaggtcacacagctaggaggagggagagtaggattagacctagttctttggctgaaagtccagggccttagctcctttgttaaagtacatgcttaccatccccagctgatagaatggatgcgggggaaatagtgagggggtataagagtgcccattagcagtagcctgtgccccagctgtctcccaccccacccctccagatcctacagtgcagtcaggcttgtctaggaaggtctccagcgggacccagggctctccccgtgactggctcccaaccctcaccccgctgccgcctgctctcacctgatgtcatcctcattggcaaagatgatgaccgccctggcgtttgaggtctccaggaggcgacggatgatcttgtcaaactccccaggcttgggttcccgcggtatcttcactgactgcgcgatgcacacgccccctgtgggaagggcgccagtcagcctggggcagggggcagcaccagtctctccccgcttcaccctacaccctccaatacatactccctccaggagacagaggccagggctgcccatggcccccccagccagacttctagctcacaggtcctgatctgtgcacaggcacaggctgtgcagtcagaactgccacggtacaaattttggttccaccactcaccagctggatggccctgggcatgtcacttcagttctctgtgcctcagttccccagcctgtaaagcaggctggtagcgagaggcaatacagcatcatgtttaggagctagactgcctgggtttcaatctcagctctgctgcttactgcagtgtgacctcagggtggtgactaaacctctctgtgcctcaaatacatcatctataaagtgatgacactactacttacttcacagggttgttaccaagctaagtgagttagtgcacacaaatacaataatacctggcacatagggagtacttagtaatggtggttattttcgttgaaaccatctcataaggtttttttggaggagtaaatctgagaagagagcaagttgcccaccctgggctatcagatcaccacgcatccacatccatgtcatgtgcacctcccagggctcttgtccccaggtcatgtgctcatcaaaaggtcccttgatgagaccactgtgcatggctgctgactcatacctgtgcatctgaggcctatccctccaggtcttcccaccctttccaggctcttcagcaggtaggctccccagctccccctctatgccctgacccccacagggtgccttgatgcctgcctctccccccattcccagttcaagaactcacaggaaagccattctaatgtgtgtgcttccggtggagtgaccagaggagctctgaatgggtcagggggtttgggagcccccctgtctctcctcctttggcccactgcctgcctggctgggtcctggaggaggggccaagggccggagcctgactatctcttgagctgtctgcctacaagaagcccaacccccatgtctgcagaagcatccaggaggcagagtcaatacatccaaggccagattcacatccaggctgcaaggctcacagaaaccctgggagcacttcagacttcacccagccagttcctagccttagacacgtctccagtgttggcaggggacagatgtcattcgtgcattgaaatcccacctgacctcctggtacaaaagcacctatggatcactgttgctgttatcaacagcatttgacagatgaggacgctagacaggaggagaaatcacacagtcccctgcccctactgagatacagagcaagggagcctccaggggctgagaacaccagggtccctggtggcagagtcagggctcaactgatggaagagcatgggggattattcttaaggaaacagatcttttatctaagactgtcagcccctctgggtcctactcaagggtcacagcccagctccaccccaaacaggatcccctggggacccagcaatgcctcaaaccatctaccttggctgggcacctggctgctgcccacgctggggccacttgacacttctgcacagactccatgtgcctctgtgtggggcccacccaccagccccaccagaagtgccaacagtacccagctccactccagaaggagcctctaggggcgcctgggtgactcagttggttaagcctctgccttcagctcaagtcatgatcccagagtcctgggatggagccctgcatcaggcttcctgctcagtgaggagtctgcttctccctctccagctccccctgcttgtgagctcgcgcgcgctctctctctctctctctctctctctctctctctctctcgtaaataaataaaaatctttaaaaaaaaaaaaaaaagagcctctacccttggaacagaggtggcaatcagggaaggctgtccaaaggcgatgaccctgagctgagtctgaaggaggaggcataagcagccagatatgaggcattctggagaggaacaaggtacactcactagaaggggggtagttctgtgccaggcacctgccaggcctgaggccacacgacacatgcacactctcacatccctgtccccaggaagtagaccccaccctggttctccacagcaggcaaagcagccatggtgctctgccctcgcccctgactagaacccacctcccttactttctgcctctttcaagcaggccaagctcctcaggtctctcctaaggcaccaaagaaatccaaagcaccagagaagaccatggtcaccaggagctcatggggaaggagggagggtccttgggcaggactggtccctccagacccaggtcccacagagagagccaaagggagccagtctgctgcccacagcacgggccatgtgctaatggcagctgggcaggcgctcagctcccaactaaacctccatatggttcctttccagttagaaagtgggccaattgtgacatttccctcccatctggagagacagatggacaaggggaggcggctggacagggggtaagggtgagccacctggctccaggagggaggaggggggccaggggcataaggaaatgggagttaattgtcttcaaatggggagaaactctcagaaaaggggtatttctgggccacgcccccccccccccccccaggaggatccccgggattgtcccccccgacaacccagggcccatcttggatggttcaattttctggtgaaagaatttaatgaccccccctccctccgcttaaatgagaatgagcccccaggtaccttacatgggaggaagtccagcaggaactcttcaacccaaaaaggaggcattgaacggcgggggggggggggggggggggggctccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaattttacatggattcacttcatatggggtgtcatcagcacatctctaatttctagatgaagaaactgaggcacagagaagttaaaggggcttcccaaggtcacatagatagtcagggggagggggagggtttaaacacaggccatctggctcccccattgtgtcatggctcaggccatgtggggaaggggctggtgtacaaggtcaagggaacacctgcagcccgtagacatgggcatgtctgggcacactgcccgttctggagtaagagcccactggcgtccggggtaaaaagcgaagtacccacagggtccctttgcattgctgcccaaatgtcagcatggctgctccagggaccccaggatggggattaagcaactggctcaccgggggctgtgccagtgtgacacaagctcccagcagtgaggggcatctatctcagctgccctcctggccccttgctgcagccagagaggaccggagtagccccagagggaccagcatttactgaagcatccactccaagcctggcacgcagtgaggcctcacaccccccagggcaggtgctagtagtcccatcttacagatgagggctgaggctcagaggtgctaggcagcctgacagaggtcacacagcccggaagtaggaatgcaatctgggtctgtgtccagaccctctctcaggcagagaaagaaaaggcctgggtcactgggtctctgttgagctctgcttcccgcagcccctccccacccctggaaagaccccaatcacatgccaaacccgccagccctcttgcctgctatcctgtagctgtagctccatcaccatcgctgtggggatcatggctaacacacccctgggaccccctcttcaaccctctctaccagggagggagttctcctcaccctactcctttcccccatggcctccctcattggataaaatacaaacccatgagtccatatggacagtaaacagaattgaattaaacctaagtagcaagaaacaagcccactccctatctctgctcagaggttgaaaccttctacgtctcccagactccaggcataggatcataagaaagcagggagcatggaggagtccctcctaagcgcccccttggccagcccctcactctacaccccagcctcccaggccctgggtgagcacccagctgccagctacaagctctgctgcccaccaagtcagtgcatccactcacagggccacgggcacgaagccatgaccgcttgccaagcacatctgagcacttgggagcgcagggacctcacagacctcctggcccaggttggacagggagcaaggaggacgaggcccgagaggaggagtgctttccccaggggcacacggcagttggggcagagcccacctccagatgaggctctcgccactgcaccagggggtttaaaatccaggccagccctctgtggcttcttcccacctgctttgtcacagaataagcagagcccccccaactaaacccagtgaatgttgggacatccccttacctctctgggacccctcccacccccgccctccctcagctgtgcagtgagtgccccacgtacccccagctgtggcagcccagagcctgccctctctccacgccttcccctcccactggtcaaaactgacccatccttggtcccctcaaggccctgcctctgctcccagaaagctgggagagtggccactgaacactttggagactacatagagacattcagtaaagtggggtgcgctgatcgcctataagctggcacgcccctttctacattcctcccacaggaacgcacacatgggcacaggagccccacgcagccatgcactgcagcaccgtttgcaaaagcagactatcggaaatgacctaaatactttacaacagaatggataaactgtggtgtttgtacagtggaaagaaaatagctctcacaacagtaccagcacaaccgaatcctgagaacaggaagttgatcaaaaaggcaaattgcaacatgatgtgtcccgtctatgaggagcttaaagatcacatataataagacttaatgtatagggagacacacatccatatgaacaaaagctgcaggaaggcaggagcttctgtctgttgcactcatcgcaacctccccggagcctagaacagtgcccagcacatagtaggtgctcaataaaagtatgctgaatgacttccttctaccaccttcagagttgtggttacctcaagagaggaaagcaaaagaacaagactgagaagggctccatggggtgggaggggggcagggggattggcttctagacaatccatgttccatgttttacttctttaagcaataatcagaagcaaatatggcaaaatgtaaatgcttagtaaatgtggaccacagaatccaaatcagacaaaactttcagacacaaggcacaatgatggtatgctcgtcctcatgtggtttgtgctgcccgatggaggacacaacgggacacaccccagcctttcctttccatctgtggaatggagccccttagccgctcccagcccagtggcatccacagggcactggagggcggggagtggggagcctgccagagaccgcccttctcccaccagccttctggctcctgaaatcctatctgcccctgaggacaggctattagccctcccctgtgcctcccccagggtccagacacctgccctgacttgaatgtgacatagagactccactagcaaaacttgatactggcttcctgttgtattttgtggtctctgagccccttctatttgcggtctgatgacctttcccagtgttctccaggtccagccaatgtatctgtgtcagtgtctgcctccaactgcactccccaagggcaaggccgggtccgtgcgttcgtgtgttccttcattcatgcatgctttcatccaagaagcgccctgctcagttcccagcacaatcggatgctgagaaatgataacaagcgagatccctaccttggagctcatggtctagttgggaaaagcaagaccaggaaagagagcaatcagccggaggagaagtgcaaggggacaccctctgggctggcaggagtagacagtggcaggggatggcccctgggtgccaggcccaccgcatgcttctctgcacttcacgcatccaccaacacaccctgcccgcatgctgctactttcccttcatggagtcaacaaatgtttaccgagcttgtctggtgcctggcaagttttagatgctagggcgcagccgtgaggatggggcccctaccctcacacaacctgctcatggtggcagaaaacctcttggaggcggggcagaggaggaaaccagcagggtgatggggggcaggggtgggggctgcatcccctcattccaccccgttgggtcctaaaggacaaggagggtcaggccaggctgtgtagcttaagaggcagaggcaaatttgagtctgctctgacttttcccttggagctgctgccttgcccgagagccaggaactgaaaacactttagacttgtaaatcccaccctcaagtgagagctcgctgctaaaatgacctggtttctctgtcccccagtgcctgggattgtcagcacctggctccctccatcagcaccggtgacccagggagtttgtttgagcacagggacacagaaaccgccaggcaagaagggacaccccgggggagccagtcagccagccttcctacctggagggctctccctcgtgccccaggggactcaggtttacacacactgcacctgtgcccagcttcctcgtcctccccacacctccctgccccccactagatggctcttcccattctaccagtctaaagaagccctccccaccatcctgccacccgcccccagggaacctccaggtcccctgcctttgcaacaccccacttgaggtggccttccaccagagcagcctgctttcacctaagtccaccccaccatgttgggggcagtcaggggacccgggctctctcctttctccttcctccttccttccagaggtctcaccctccaggcttgggcatctgtctctccgtcctagtctcattctctcactcaccaggagacctacccttgccaggccctgagtaaggagctaagtggccagcatgcaggcagcgggatgggccccgttgggcagagaggccaggacagggcgccgcatccatggctccccaggggactccacgtccaccccgtctttccccagctcccagggccctagggtcacactcttctacccaggctgttcaactggcctgaatagcaccctgagtgctaggctctagactagggaggagaaatttccctacagtggaagcatgcaggtggcccaggaaggcctgttccctcacagcacagtgagcagctgcagaccagcacagacacgggctcctctcctctttttcttttcttgcttttttctttttttggtccttttaaatttaaaaagggagaaaaacaataaaaagacaaatcctgggaaatcaagtggaaaaatctacattacagcaaaatgtgaagacagcaaattgcaacatagaaagaaaggtggggggagttacacaacccaaggggggtcccaggttcctataggttcccagcagagggggaggtgggaggaaggcatgaggcaggctaggagttaccctggaccatatggcaccacacacatacacatacgcacacgcacgggcacacacacacatgcacaagcacgcacactcagccctgcctcccactccaaaagccaggtcctcttcccaaatccgctttcaggagagggacccactcagggggtcagtgactaatccagtgctacttttgttttcaggcagcagagctgtggctggagggtgttttgaggtcaggaagatgccaggccctgagagactgcccctgatgcctggctgttccagggtgaggagggctgtgggagcaagtgagaggtaggcctggactctaaccaaccctggctcctgctgggtctggggctccccagggggcttaaggcctctagttggggggagggtggccattcaggactggttcacggccactgtccctttctgctcctgctcccagacctactccccactactctccacttgacacagctccctgcctacaacccccagtgactctgtgcgtgcatgcacgtgaatgtgagacagagatggagacagggacagggattcgaggtccacccctcctcctcaggtctctaacatccagccttacccgggcccctacaagatctgctatccaaccacatctgctgcctccacaggccttcgcagaggatgctccctctgccaggcccccacctggtgctgcagggaccctctgcagccttccctccctgcaccttggatatatccttagtgtctgtagctctgctcagagcctcaaagggcccaggcctcgtgctgtacctgctcgagagataggcactgattcatgcttgctgcatgaatgagccactgcatagctaactgagggggatgggagggacagagggacagaggggcaggggcagctagcagggagtaggggcagaggctctgcaggaatccagagtggggacccatacctgctcaaatccttctgcctcctctgggagcccctgacccctgcacctgtgacctcccctttgagttgccgcccagtcatgctgagtgcccagacatttgtatgccaggcactgggcacccactttgtgcctggcacctcgtccatgccagactctgggctccagagataatccattcacagcatctgcccttgcaggatgcacttgtgagctctgcgcacatgcatgggccgggcatcacacacacttggacatcttcctcagtcttgccttgcttggagattttatttctccaactagatgaaaattccttgctgtgaacacttaggaaaaacaagaacaagtgagggggcacctggctggctcagtcagtggaacatgcagttcttgatcttgaagttgtgagttcaagtcccacgttggggatagaatttacttaaaaaaaaaaaaaaacaggaagtgaagaaaagtgtaagagaaccatacaaactggcaggtcctcagagtctgaagatagcagggccggtagaaaagcatgaagtagaatattcaccctccctgtatgaccagggtgacttcccctagggaagaagtgggccaactgtgagagatttggctggagccaagaagactcaggtaccaagggacaatgaagagaagacagtcccccagtttcctgtccaggtgcctccctaacacatgccaccaaaggtctgtgccaagcatgaacactgcacctgcattcggcttccccccacccccgccccgcccctccagctcaagaaagagcatgctagctgcacagcttactggctgtgtggctttgaacaagtcacctagcctctctgagcaaaagaccttccaactacaaaatgggaaaggactgggacacctgggtggctcattggttgcgcatctgcctttggcccagggcatgatcttggaatcccgggatcttgtccccacatcgggctccctgcatggagcctgcttctccctctgcctctatctctgcgcctctctctgtgtctctcatgaataaataagtaaactcttttttaaaatgggaaaggacttaaagaaactgcacctgatggagttgcagtgagggtcaaaggcagtggcgcctgtgaagacctgggtctgcctcctggggccaatgcctttggggacagttgaggacagtgggggtaggagctgctcacacaggagggcgggagctgggaagacagagaactcattccccaggccaaatcaggacccagggctgctgaggtgtgctctgggggaccagggacaccatgataaaccaggacctgaccccggaaacaaatgctgggcaaaacatacacgtttcccttcctgaataatctcagcacctagcatcactcccagccacaccccaacacacacatacacacacacgtgcacacaggcaacacaccccttcacaagtcacataccccaacctcacactaccttagggccatggacccgcatgaggccaaacccagccccaccccatcaccagcacgaacctgatgacagcctgtgcagaggacaggcacatggccacactcaggcaccaacgcacagtcccactcacacaaccaacagccacacaagctcacgtggtgactgcaaggcctcacatgaccactcgccgcacccggcctccctcagtcactcagccacagagctgggtacaccagcacactcgtgtgtccactcctccttgaagctgccacaccagcaggaccacacctgggcaccattcatacctcccctgcactgctgcctctgaggcgggcctggcttgggagtgccaggggggtgggttagtgacctaacggcggggtatggcacccctgtcttccaacaactatttaccaagcagcttcggtggcttctctgtcaaggcaaaccctgtcttcctgctgaaatcctgtccctctgcctccactccagcccagccttgcccctgtggagaagcaggctggctctggggatgcaggggacacagatccagagccctggcctagtgtgacataggaggctgagtatgggcacagaagggcccatgtcgcacttcaaccaccgggttgctttgtggtaaaagctactttgcccaagctctccgaacatccatttctgcatctgtgatggaatgacattacccccacccccagaaatacaaggttgtcgtgaagatggacgggatcccccgtggacatatctggcctccagggcaatacttaggggagggggagagggcaggttaggggagacttatcagggcagctgtggggctcactgccttggagctgagagctgctatctcctccccaggaggctgctgggcagtggcagccttgttcagagctgcattattcatggtgctcagctctgagcagagggaaatttgctgagtgatcgacctaatatcttaacacaaacccatttaggcaaaacacctttgaagcaagaaaggcaggaaaaaaaaatagaaaagaaagcaaagaggttcggaggcaggtagtgacaaaaggctggttcctatctgcccgcacccccagcaccccccccatccacaggatacccctgccccgactcagcccccccaacctccactttccctgactctcaggcatcctttggttgaaggaatcccacccatttctcagatttggctcagagaggaaggagtctgcctaaggttcacacagcacgtcaggggtcagccggacccaggtctgctgagtgctagctcagaattctctgctaaggagcccttcacagagcaagaccccagagctccagtgacacccctgcttcctcagcctctagctccataccctcatacagcaggacctctttctccagatcaactctgattttcccgccctcagcctctgctggtccctctgccagaaatacccttcctgctcctctacccatccaataccctggaggggctcattttctcctccacttccccctggaaacatgccagctctctggcccagctggagctcaccatgcccatgtgggctctccccacaccctctccactggcacacggcatcctcctgcttgtgccgtggcccatctgctaactctcctgcttcagggtgccagggctcccagctcggccacctctaggctgggtgactttggacaagttacttacctctctgagccttatttccctgtactacagtgtgaagaatacacataagaggttaatacacataaggtgctccgaacacagccaagcgcacacgcactcagtaagtgtttgctcttgtaatattgtcgggtttctcccatcaccccataagcccctttcaggggagaccatgtctttctcctccctaactccccagtttccagcagagtgccaggcacacaggagggactcatcaacattggctgaactgagcctcatttccagcagcatcctccacctggcctctccacaccagactccttgagaggaggagtcagtgatgggctggttgcgggggtggggggtggggaggggtgtcgcctggggggggcaggggtgtgaagatgacctctggctcgctccacccccacagcaggaacgtatgctcggatgggcagagagaagccagggcgaggggccggctgcctggcctgcggtttggccagggaggaacaggcagctgcaggccgggataaaatatttaggagcccacatccccaggaagtggagactgacaagcaaaatgaaatgttgagatgtaattacccgggcaggccaagcatgtctccccgccggcggcgggctcagcaccgccccaactgccacaagcaggcactgggtaatgaagtcctcctgggccctctcccatgccagcccttgccccctcctcttccggccaggccagcaggaggggcagcagaacagcaggacatgcagcaaacagggcgggcggggagggcatggtccagccctggcatagatccacccaagcaatcccttcacctccactgggcctcagcttcctcagccagaaaatggggctgctgagccatgcccaggagggaggaccagacggcgaatgtgcgcgtgcttcattaactggcatgggcagaggacaatgaaaggacagcagtgaggacagcagcagacaccagcctgacccagcatgccacgagaggcattcttgaggcgctgggctgcccaggactcagcttagcagaagctggtagaaaaaggtctggggctgaggcccagatgtgggtgggccagtctgctgtgctcacctcacccccagaaaccttccccaggccctcctaacatggttaggccacatccaggagcagagagacaggcacctggacaggggctccaggcctagatcctgctttgctcagactcttatttctgccttagtgcccaatcaccctgcccagactcctccttcctcaagtcagcacctgtccattcttgaggattcagggcatggcctactcctccaggcagccttcgtgggtatccccaggctccttctcccttgggagcctgtaacaattccaacatctccatcactgcacttagcacagtgaatgaaaattatgggagatggccgctgtggggcccagagcattcactgattcagcaaccacttgctaagcagccctcctcccagtaccaggcactgtcctcgacaccttggctacagttactaataggacaaccaagaatcctgcccttgtggagctgatagccatctatggagtagacaacagatgctgaggaatgaacgaactaattaattaagagtcagtctaccgtccagaaggtcttggcctcagctctgctcctgtctttctactttcctcttcctgtcctctcccaccccatcttctgtctcttatctctctctctctctctctctctctctcacacacacatacacacacacacacacacacacacactaccccattattccacagaccctcatgttcatacagtgctcacatgttctctcattaattcctcccaatcagcccacagcttaggtgaccattttacagataaagaaaccaaatctcacaagccagagcctcatcctggctgcctccctgttcccttttgccagcttctcttcccaccccctccacctttctaactctttctcccaccttctggggtgactggcaagttgcctcctctctctgagcccatttccctctctgtaaaatgaggcaggcaaggcaggctctgggagatggtaaatgggacccatgcttctttcccccattctccactcagcagcccaagctgtgtccctctccatcttcattctcatccctccctcccctctcctcttgcttgtcaccttgtcctgcttcctcctcccatcccaaggcctcccttgggtcccaagatgtctgtaaaatggtcgttagctttccttccggctcattaaaaatgcgaatttgcatagaatacccatatgatcattctgtctacagcaaaatgggacatgaatataaggcaccatgcaagtcagggagaaaagggaggacggtcacaatgggaagggcaggaagaggccaaatgctcaccactagagtctcaggcctcagagtcagcccccctcgggcccttcagcccttccttgccctttctgatggctaattcacctgttttttcattcttaacagtaaccagcaaaatagggactgcaattatccccattttacagatggtaaaactgatagccaaagaggaacagtggcctgtccaaagacacctacagcaggtctgtggcattcctggggggcagcactctctgccatggactagactcccccaacccacgtaggcctgctgctctcaccagaatgctgcccctcctccctctcagaaggaagaggtcatgaagagccacaccagtcatgcagttcttctacccagaacagcccctgctcctctgggacaggcccaccttttttaaattctcctcccatcgccctctcctcaaggaagcttcccctctccaaaacaaccatttagccaggtgcagaaatttttggagacaaatgtttccaaacctcttctcccagctatagacagttgacccttgagcaacacgggtttgaactgtgcaggtccacttgtacgtggatttttcttggcccagtagagtactgtaaacatcttctctctttcttgtgattttctgagtgatattttcttttttctagcttgctttattataatatcacatacaaaatatgtgttaaccaactgtttatgttatcagtaaagtttctggtcgacagaaggcaattagtagttaagttttgaaagagtcaaaacttatatacagattttcaacagcacaggggccagtattcctaacccctatgctgttcaaggatcaactgtaattacatttagacctgcctcatcccaaaaagaatttgcagcagtgcccaaaaagaaatatacttggctaaaaagaatttgataacagaattgaggagatagaacctctactctatagatgaggctttgctcagcagccacagactggcagagaactggcagtttgttgggaccagagccaaccagggcttcccccagatggcccaccttggggcaattgtcactatccgtggtgctgaacccaggtgtgcacgcgtgacctccagtccacatgcaatttaggagcaagtccttcgggctggagcttcaaaatacaccctaaatctgtcccttattatcagccccacccccagcctaagccaaatcacttctcacttggatgatggcaatggcctcctcacttgcattcctgcctcagtgcctccctctgcccagtctgttccccacacaaagccagaaagattctattaatctcaagtctgttaacatccctcctcttcccacaaacctccaatagttcccatctcattcagaacaaaatctaaagttctcccagtggcctacaaggccccatgtgacctgtccctcttcttctacttccctctacctcactcactctgctgcttcctcttggctattccccaaactccaggaagcttcccacctcaggccctttgcacttgctggtacctctgcctggggcactcttcccagagatcacaagcctcactctctcactgcatttggggctcttctcaaatgtccatctctgcagaaaggcattccctgaccaccttatatgagataatctcccctatctggccctctctgtcacttacactgatttattcttctccatagaatgtcatcagctcctatctaaaattgtattacacagtgatgcatttacttgtttgttataagctcctttggccctctccccaaatgggagctcacaaggccaaggatctttgtctgtttggtccactgccataggcccagtgtcctggttgaatgcctggcacacagtaggtgctcaataaatatttatccagcaaatgaatgaattaccacccaaaggcaaaagatgaaggaggaaatccctcactcctcctcaccagctacatcccatggagctggctctgtgtaatttagaggcctagactccatctttctgagtccctaagaactctaggaacgaacacgaggggagctagcattgaagaagtgactagcaagggatgtgtccctctctatctttggggactgttagacagggcctctcataggctcatacacagccatcatgatggtgacacctgacccacctcccaccaccaccccacacacacacactctccatcagaggaacccctctaccctctcctcctactctggctctgagcagaacctctggcctttcttggggacagtccctgtaggtccctccctctggctgacccaccagcatttccctggagaaggccaggtaaaaggcaggctcaactgcctcaaagaaggctctaccttccttccctcaagttccagagtcacacagacctaagtgtcaaccccagctctgccactgccaaagcagtgagggcccaggcaagcctgtgggtaacctgagccatactcgcctctactaaaaaaaaaaaaaaaaaaaaaaaaaagggacaagtctcagagtggctgtgtaggggctcatactggggccagagcctagcagcttccgtgaggacagttaatgagatatccccaagaactatgtatattaaaacaaaaggagattcaggggttttccccaggccaggccagcagaggagccaatgcaggagtcagagcctgttggggctcaaagaccctgggaaggggctggtggacatagaatagcaaggcaaaaatggctatgagcatccctctgtgtgtccatgtgtgtgaccccattgaagaaggcacccagcacctttgtggtcttactgataaagaactggaagctcaggaagggaaagggactagcttaaggtcacacacggtagaggataaggctgagagtcccccctgccccaggacactcagcagccccatagaggcctgaagcaggaagtcttagggtggagaagaaagaaaacggtgagctcacagggtctttctagagctgcagggaaaaagcagtctggagcttgcttcagctgcatctccaaggagctcagagtgaggtggaccccacctcagatgggaaacaggactggggaccccacctcagatgggaaaacaggatgaaatccaatagtcagccactaggtgcagagggttcgtgtaagtcaagtcccaaaccccagcagggaaaggtcactggtcttcactgcttgctttttaacaaaagggaagaggtcagaagggatcaggttgccatgcacagggctcctctgtgggctcaggtccagacccaagaaccagacacactggcagctgaaggccaagcctatggtatccagattttcatgtgatgaggatggacagaaaagctaagagaggtgagtgaggcatgcagagatgcatgctgggggaactcgcaggtcccctaacctatcaccttcacattggccatcaagctgacactccaagagggaaagtgactggttacacagccacccagagacagagtcagaaccagactgggccccagtgcccctactctgattcgtcatggtgacaatggatgcacctttggtagcctggtgtttcacttagggaccagactgtgctaaatgccttacaccaattcattcactaaatgctcacagcaacctaatgggggtactatctatatccccctttcatgaagtagaaactgaagcccaaagaccataagggactgctcaaggcggtgcagagtctggcggcagagacagcatctgggctcttaaccactccactctactacagcatccagaggacagggttcagaaggtcaaagccacaaaggggctgcaatccacaaagggaagttttttaaaccccaaagaaatcttcaaacgtgttccacaaaggaggctggtgaaaaaaaaaaaaatgttgcttcctgtccaagagggcagggatgcaaattcagagcaacaagggcttggtgtctaatattttcttcctcctgtaactcccatcaagcttagaggcaaacccagaatggagcacatccctgctatgataggccagggtgaacacatcaaagacggaatggagagagaaggaaaagtgacccaatgccacccataccaggggactcacaaaataaagaggtgtcagcaccttgccaaaggccagagtggcagagaaatcagagtggacaggcaaagtccccaaggcaggtcaggcaagcttggggttatcttcacagcaatacaaagattgacctggaatcaccgagcagtcacattgatgccagcaccttgccaatctccaagcactggccaggagactcaactggctcgtggtaggcctcatgggttggcagggggtacccatgccaggtccacttaatttccatctatagtagagtgacaggcagcagaccaaggcaggggaagtcatgatgggtatcaagttcaatgaggactgactactaagctagaatggtgggtactggctgcaaggtggggcccacttcccttccgcatccttggaaaatacatggctagtgggcagggcatactgggccccagctgctgggtccctgtactgtgactcccagaagcagctggggggagagtccagaggtctccccctcagaagatgctacaagctcatatataccaagctaaagccagcagcaggacccctccctgcttccagctccccagccctttggctaatgtcaaccacatttcatctgattacatgctccaggctctgtccctgtacaattggcccaaatcatccctgaaccaaaagaccaaactctgaagtgctaccatttgatactcattcctctgggtcttcagggatgtcttcttttccagcactcctctgagagcctttgcttatggagaaaaatgcctggagcccagggccatagactgtgaggacacagcctgtagggggcagagttagacactggagatgaactgattacagatgagggaaggagggcccagaaggacagtgatgggcccaaggacacagggctggtcatctgctggcccacatgttcattccataaacatctattaagctcctgctgtgtgcaagagagggcaaggaggacagagccaaggagcccttcctttcccagcctcaagaagcctagagtcaaatggaagaggcccagggaaagttcagtaagcactggggtgggtgtgcttgaggcttcccaggtggtgagccctggggacaatcatcctccctcctggtgagcatctctgcctcccagggaggaaagcagatgacagaagccctcagggaggcagggccttggcctgagccttaagggcagagaggacccgccagggccctgagcaaatgagacacagaaggtggagacggtgtgtgctaataccatcccttgggtaagcacacatgaccccaactgccaaaaaatttttaaataggattggcttgaaaaaaactctgttcagttccatgtcacactactccctgtcccatggccatgaggaccaggccaagcccctcagcggggtcccacctgcctgactcactcctacctccagcctcttactcatgctttcccccagctggcatgcccttcccctcctcttcacttgtctaagctatgtctttgggccgatcccctgcaaccctggagtatatcccttactttaccagatgcatggtaaactctactgagcccctactgcatgcagggcagggcgtgaggtcaggtggtacactgctcccctcaccctacccagagccagcagggcccctgggacctctcctcgcctcacacaggagctgcatacctggagggtgtgaagcccaggccagctgggaaactcaagcaggtctggaaagctcagtgtcctccccttgctgcactccaggaagaaaaaaaaaaaaaaaacacccccaagccaggcactgcagcaagaaatgagaggaagcagggcccttcatggcagcctgatgcagctgcagagcagctccgagctctcatatccctgcttctgcctccgggaaaggattctgtcctcggggagtcaggagagggtcactggccagggagcttagtgggaagggagctggggtctcagggcccccggacctaagcccaggtgcctctgctctgtcgacctcagtctgcccttctgcaggttgggagaacaacctcaggccccctaggagaagagctaaagaagaaagcagctgggggtggagtctgtgatcgatcagccactcgttccccagatatttactaggcagctgctatatgctggggacttgctggggattcagcagagagcaaaacgggcaaaaaaaaaatctctgccctcgtagaccataaacaaatataaattgatttgtcaagtgctataagaaaaacagagccaggaacggaatggagagcaatgggccaggggaggggctataatactgtggtcagaaaggcctctctgaggaggggacagctgggaagacacctgaatgtggtgaggatgtgggcatacggacattcacagaaagatggctccaggcagaggggccaccagcgcaaggctcctgaggtgagctactacccagtgtcagaggagcagggaggaggctggtgtggctgcagcagagatggaagggaggagaaaaggccaggggcaacgggaagggaagcaggcattcggtccactctcagggctctctggatcctggaggcacctctctgctttcccagatacataagcagagctagcatcccccaaccccggtggcacaaacctttccggctggccaacctcttccccatccccttggagcctccaggaggtgagtgttccctttacagccagagaagctgagtccagagatgtcacatacacaaccggacgaggaggcgccccagccttgagcctgggctgccgccccgccagtcactgcccaagctgctgcgctgctgacagggaccatctaaatgcaagcctgaagctcagcagtgggagctggagctggaggtcagaccagtaacagcttgactcaccagtgtctccggaatatcaataggggacacagggacacagcagggagatgaggctttggaactcctcactgtgcaagggacagggtgtcctccaaggagctggcctgatccatccacccccgccctctcctgctgcatcgagtggccaccttgttcccaccttagaagcccatgcctggaggcacccaggaggctggaatcgctccccagaaaagaccagaaccaaactccccaggtaattccatggagacgcccttgtcaggagctgacctgtgtccttcctgccacatgcacttgaggtggggggaccatcagctggattcaaattccactcctgctattcttccagctgtgtgacctcagggaacttacaacttctctgatcctcagttttgccatccgtgtaatggggttgtcttgagggctaaatgagttaacatgtatgaagtacacaaaaggagatctggtccacagaagggctccatcaatattacctactactaccatccactctcccgtcacccacataggaggccctaggatgctactcctgtttgaccttaagcagaccttaactgaccttaacttctctgagcctccattttcctcattcgtgaaatggagccctacaggaaataaaccgaggctcacatagggccccatggacaaagaaaggttgtgggggtataagaatttataccccaggccccacccctgagagggcccaggatggtggagggaagcacccagggcaaggccatgtctcaagggtaccaccccctcatgcctgggtgactcagtcacattatctccagagcccaggcggagtctgctctgcatgcctaatcccaacatcggtttcactcctgcctctctgccttcccctcagcacaggctccccctggcaaggaggagggagtcccggcatccaaagacgacgggaagagcaccagacaccgcacgtgagcacgcacacaggcccaccagtcacatgtccagaaaatcacaaatgtgcacccccaccaccacgtgtgtcctgccctcacggcttctggagctcacctggctgccctgtggctgccagaccagctgtcctataagtaccagcaggcctgggctcctatggctttgtccctagccttgtccctgaacatgaactacagcttcagttagcgcccagcatggtcccctcgggcgttccagctcacccggggcctccccaggagttgccgggcaatggggaggccggtagccaccagatcccccaataataaccctccgatatgtgttcctgggctcccacggctgtgggccagaagcatgttccactctggtagcaaccaggtttatcctcatttcacaggtgagaaacccaaaactgagcagctgagtgactttcccgggttctcacagccaataggtggacaagccagagcccagatctgcctgccagaagctgcccgctagccacacgctgccgcctctgctacgggggccgcggggagacgggcagcatagtgttgaaaggcctgggtgggggatccctgggtggcttagcggttgagcgctttccttcagcccagggcgtgatcctagagtcctgggattaaatcccgtatcgggctccctgcatggagcctgcttctccctctgcctgtgtctctgcctctctctctctctctgtgtgtgtgtgtgtgtgtgtgtgtctcatgaataaataaataaaatcttaaaaaaaaaaaaaagaaaaataaaagaaaagaaagaaaggcctgggtgtgacagccacactccaaggcctgctccaacacctcactgtgtgagcctgggcaagcccctctgagcctcagttcccctatctgtaaaatgggaacaaaaagaccagcccccacagggttgtcaccaggattcatgatggtgcagggagggtgcctggcacaggacagggctcagtcaagggccacaggaaggtctgggggctgagccacaagactgaatgttcaaagtaggagcacacagcgctgatgcgggctgggaaatgcaggaccagggcttcctttaagccccaagccaatggcccaatccgtgctgggtgcaatgcaagagctccccacacagaggacagagctgggtttcagttcctggtcctccatatcctggttacgtggttggggaaatgacctactctctctggccttagtttcttctcttataaaatggacacaactgtgctcccctacaagaccccaagcccacacaacaggcacccaggacttgctggccaagctctcccctcagctctgatgtgtgtcctcagcctagcaagtgcaccctcccctctactctgctccctggcactcttctgagcaactcacagatgatttatatttcagagagtgaatcaatacaatatacggccaaagacatctttaatctttcacagggattaggctacaaggtacagtggcctctttctacaggccgctcaattctgatttcaatttggccagctggagcgcagctttctctctcctttttcttttcaccacctaaagacgttcctccaaatcaagtttcattttagcaggtggggtggggagacctagctgcccatacccgaggggaagcctagccagggccctggggctgcagggggacagaaggagcttttaaggacatggaagttcaggccgggtgggaggccaggccctcggtgatgggagagcacacagagggcaggggtgcggtgacggacacctgtaccaggccaggagagcccctgagctgcaggcgctggcagcacagctagttttcttatttttctagaattctttgtttttaaaccttttgtaacaagatattttgtgtgtgtgattttctttatttattagagagagagagacagagatagtgacagagaacattagcaaggaggagagggagaagcagctccccgctgggcaggtagccagatgcgggctcgatcccaggaccctgggacaaaggcagacgcccaactgttccagccacccaggcacccctttttaaaaatcttgagtaggctttatattttctagccaccaaatgagatgcttgtggaaaattcaaacagtagtctaagtttcagccaaaacacaaatacctagagctcatcccaatcccatgcttctcccactcttaacacaccagcaagtgtccctccaggctctgtgtgtgtgtgtgtgtgtgtgtgtgtgtgtgtgtgtgtgtgtgtgtgtgagactgtcatccccccatccgtgggaaaggggggcagaagatggagcgatgaatacaaaagcagttccgacgtctcatcctggagccagacagcctgggttcaaatcccttcttcaactcatacgtggatggcctgatgtcggttttctttctctctatgcctcacttcctcccctgtaaaatggggatatccacctcacagggtagggaggattccccaggaccacaggtgtgaaacaggtgttcagcaggggccaggcatgtagggagagctatgtaagtgctgggagtggctcccagggccctatggctgtgtctgaacacaactgaaaactaaagctctagaccttctgtccgtccctctagcacctttgttcccaaagcctgtagaggttacaccataaacagggaggtggtgggcttgtttgggaaaggattccagccaacgggcagagcaggggatggggctaccccagagagaggcacccacctccgagcaaagcagcaaaggccctgtaggcacccagagggagggggctgtggcacagggtctgacactacgggcgggggggggggggggcggcagggagctgcagcccgcctgctttaggtgggagtgggacccctccagcccgtgctgccctctgcctggccagctgcccgagcagggagtggcctggagctgcggccatcggtcagcaccgccccacttccgtcctctccaccaggttgcaggcacccgagctgctctggctgtacaattaaaggggcttatctgagatttatagcaggattatgtccgcagggtgttaccaacaccagcctctggatactctgtggtccttaggaaaagcaattagagtcctgaggttattcgggtataaatatacagatgccatcctccaaggtcgagggcgccacaatgagctatttagagatagagccttgggagaggccaggggccctctgcgaggagctgccaagaggggaagagcctgtctgcctcccccgcacaccccacccatgtgcaatgaaccatcccgcttggcaaggctcacccagacccgggtggagcccccaacccggggcctgaccacagcggctggatgcacaccaccaccaccaccaccacggccccaggcagcctgccctcctcagcaccatcagaactgagccttgcagtgctgggggcttcaggcttgcctaggtattaacccttgttataccagtctcttaccgctggctggtatctaaaagcgttacccctggagcttctgaggacaagtaagggaatggggggagtttaaagggggaaagctggcttgtggtaagggtagggggaggcctccaggagagcacatcactttcccaggtcctcacattccccccaggggcaccaacttccctgaagacaccaggaaccaacacagccctgctggccctgcctctcactcccaccacacagcacaatccttccaagaacctgctggtggagcccctgtctcccgggtccctgagacacccccccccaccgccccagacaaagccacctccatccccaccccttccccttctccatctgcctgaaaacagcagctgttccactggatcccatgccaggaaaactgacactccctctgtctgcctggccacgctggcaaaagtcattcacatcccctcctacccctggggggttacccagccagctggggaggccacggactgctccccagggctcagggggctgaggtccctgaggggaatggcccagggcgggcagggcccacggcaggacccagagagcggctcttgggcagtgcttggccaccaggccctgacacccgccccccttccccccctgggcccaagcacgactcaccatcctcccgggacttctggatgaaggcctccacaccactctcaccatagctgccttccgaggccagcgtggacacgtagttccacttgagggcacggacgatgtccaccatggcctgggcctggtacgtgtccgacgggaccacacgggagaagaagtcgtagcggctgttgtcactcaggtcgggggctgtggaggcgtagctgatctgggggatctgggggcgagacgggccgctgatggggcggctggcaccccctccacgccagccaacaccacaccaccactccacaccgacctccttcccatccccagagccacaggaagttggggggagacccctgatgcgggctggatgggtcctagcccacctgacagaggaggaaactgaggcccagagagtgtgagcacctggttgggtggctgtcccctggctccagaccagggtcccaatgcctcccacctcctcctggtccccgccagtcctccccatgtcctccccatgtcctctgcatccccgacaggaatcagactggcatcagagtgagaagtaactggtgcaccagcacaaaccctcctcttccagaaaagtgttccaaccagcctcactgggtcctgtgaagtcctcaccacataccccatatacatatgtgcacacacagacacacacacacaccagaatcatagaggattacacgtgtaaacacacaccagagcctctgggtgcctccatttacacaaagaactggaagatcccaggagcagatgtccccagatggacaccacagcgcagcccaaggatggggtggggctgagggtgtcaagatagacccctagaggtcatttggcccatgaccttcccccaggcagcccctcctgtcaccacccagtggaccctgtccccacagctccttcgtgctgcccagctcagaggagacagaacccaggtccctgctctcccacaaccctgcccaccccgtggatggactcgcaggaagacagagtatgtggggaccccgggaggtccctccctctgcagcctgcaacacaggccccagacaggcctccatggcagactccagccccctgcctcccgccccagctctcccagccacagagcacctttctgcccccgcagacctcaccgaggccctcttgacacaaaggtgagctgcagagcccttaagcccttaagctgaccctcttcctgtggttgatatccaaccattcccgaaggacaaacacctctcagccagtctatggcaccctcagttgagggtgggaaatgttgcagggggcgagaggatttggggtgcaccctggacaagtggctgcccacctggcctatgcctatgatgtccctacccccagggacagcagggtccgccttccactaaggacacccattgggacaaggacacggctcagccccccatgaagttccccagatgggtcctcattgaactcactcacgagaaaggtaaggatggggtaggaaggactggttttccagatctggggagccaactaaaggtaaccccaggccgtctcacgtagttcttgtggtccttctaggatgccatgaaaccattgtgatgctgtttgtaatagcaaacctttggaaataatccggtaaaagaagccagggccccacaagaagtacatcggccgtgaaaaagaacccggcagctttccatgcgctgctctggatagctctccaagacccgcagcaggaaccgagcacccagacacagctctgtgtgtgagcggcaccttgcttgtcgtgtgcggggggcggcacagattctcactctctgacgcaacagggaaccaggtggctggggggcagggttgatgggagacctttcccctgataccctttgtatattttgcatgtagaataatgcaaacataccacctgcttggaaaacaaatcacgctaaaatcttccctctcctacctgtgtcgacagcctccaaaaactagccagtcctctctgcctcggagagcactgagcatgaacacagcaccctctagaagtggcctctggttggagagttgatggttaattttaggagtgtcgttacttttagggttgtagaggttggttggtgtttaaggggctattatccagagcagcatctcagccttggcattgttaacattttggggtgtaattctttcttgggaggctgttctgggcactgaaggatgtttagcagcatccccatcccctacccactagatgccagtggcatacccctccccaaattgtgacaaccaaaaatgtctctagacattgccaagggtcccccagggtacagaaccagtgcagaacccctcccccaagtggggacctactattttagagatctgtacagaaacattgagggatgcggtgatacaatgaggtcgcgggtttgcttcaaaagaaccacagtgggagcacatggaagaaagaataatagccaagagcagacaactcagtcccacgtacacgggggctcaccgtgccatttgctttgtatgtgtctgaagtatccatatttaacaaatttttttaatgttctatttatttatttgacaaagagcgcgagaacgtgcacaagcaaggggaggggcagagggagagggagaagcaggctcccacccagcagggagcccgaggcagggctcgaccccaggaccctgggatcatgacctgaactgaaggcagacgcttaaccaactaagccacccaggtgcccctgtacttaacaagtttttaagaataagacaaaataaaacagacggcactccagggtcatccctctgaacaggagagccccgaatttggagccggagcaggtggtggagatcgtgaggccagggcctgccctaccagcctgccttcccagcaggtccctgagagaagatggatgtttgtcagcttccctctgcgcctggccctcagcaaggagcgctaatcaaacacccaggaacccactcttcctaattagaaaaagctggtctcctacttctgctgttttctcccaacccggcgctgaagtcaaaagggactgcggggatccctgggtggcgcagcggcttagcgcctgcctttggcccagagcgcgatcctggagacccgggatcgaatcccacatcgggctcccggtgcatggagcctgcttctccctctgcctgtgtctctgcctctctctctctctcactgtgtgcctatcataaaaataaataaatagatagatagatagatagatagatagattagatagatagatagactgcgtacagcagaggggtgggaagcccagggaggtctcggggcctctcacacaggggccttctcactcttcatccctcactcctccctccaagccacctcccaccactgcagtgcaggactcagcataggctgggacgacagatggacggatggatgtccggacatcaggacccaggccctccccgcactgcaggcctccattcccaaaaagtggggagccccaagcctggggttcctgcaggggaagtctgtcagcctgcaggggtgccccggcctcagatttcaggagcccaggaggggcccctgctctgctgccaacaattcctgagacccgggaaagggacccagcccctgctggttaagagggaggagcgagcctccagagcagagtcagggaaacaagccagcatccctgcctcctctcccccacacccccctcacaggctcctccccagctccaggccctcccaagcttcctagcacgctggttttgagtagagctttgggagctcaacggctcagattcaaaccccagctcagccccccaccagctgggaagcctccagcaagttacttcacccctccagacctgttttctcagctgcaaaatgggaataattataatccctgcctggtatggttgtaagggtcatatgagggaatttccatgaactgctgaccagcagtaagcactcgaaaggttagctctgaggcgagctacagtccctcctgctacaccctcctcagcctctggtccctgtgccagctctctcccagctacagctgtgctcctaggggtgaggcacctcctcctggaatgctgatgaactggccggccctccaagggcctccctcctgggcccacccaggcctgcagtgggtggggaggggcaggggcccccccgggatgccctggacggggtgcctgggacagcctggcctcacggggctctgaggtctcctcagctgtgtctttgcagccccgctggagcaggaggggtgcctgattaacattcttctcagagaagtcttctcctctgacaacagcagcatggcagaggagggggcagccacagccatgccagtgccagcacaagtgtcagctggaacccagattccaacggcgcctaaccaaccacagctggcccactcgcagtccacctgcctggcttcctctgcctacagagcccgtatcacctcctccaggcagccctccctgtgttccagagagcctgctcagacctcccacagcaccaagtggaggtcctctaggggcaccaggcctgtccccctggtgtgaggccgcctggactacttgccaactcagcaggcattctaaggtgccctcgacatgctgggcaaggccacttgtggagattcagaaaaaagtggactattcccaacacccactgcatcccccgaaaggggcaggtgggccaccccagagtgacacacagtgtgtctggagctggcacccagcagaacttcccacccaaggatgagtgactgaggggagagatggaggaagtgaagaaatccccctttctctccacccccccacgtgctcacgtttgtgctcgcgcagtctctctctctctctctctctctcaggtttctggagtgacaaggaggtccatgccacgtggggaaagacaaaagctgcttccgggcttgagcaacaatgaagatgaatgccaagcgcatcagacgggggcggggggcagggcgtgtgcgcacacgcgcatgtgcatacacgtgctggagcgtgtgccctaaacacatgagcgcagggcacgttcattcatttattcctcctaccaatagtcgctgagtatggacagcctgccaggcatagttctgagtgctggcgacagacgggtggacactctgacctcgtgcagctcccagtctacacggaggcaggccatggaggggtgatcccaagctgtcatatgggatgaaggatccaggagagaaaggaagagcagagcaggggacgttagaggggttgggggaagtctctctgaccaggcaacatctgagtcaagaccttaaggaggtgaaggagggagccacgtgggtatttgaaggagggcatctcaggcagagggaacagcctatgtgtgcatgtgtaagtatgttacatgcatgtgtgtccaggcacacacacacatgtgtttagagcctgaatttattttcaggctgtctcaggcctggccagcatcaagaaacttctgagagtggctgctccgtgtcccataccatccagaggagtttggccacctgcccagcacctcagagccccccagagcatggtccctgaaagctgatacttcattcaagtctgtttaaagcactcagggatgaaattctaccctgacctccacgaagcctgcagcaccccgagccaagaagctgggtgtccatgaccatcacacggacacctcagggccaccccacagtaacaccaaccctcttcctgtgagctttagtgtttaaaagcacctccccttcctgcctcttccctaatgctttgcacagcacataagcttccagcacaccctggagccatcctccctggactgtgcagtgacccagccttgtcatccagctttgtgaccttaggcaaacgagcaacctctctgggcctcaatttcctcccctataaagaagccacagtaacaacagagaggactgcactagcctggtacatgcaaagtgctcaaaacacacaggccctcagcaaatgctagctatttgcatgagaggaggaggtgaggcaaggaccattgtgcccattttgcagatgagaaaacagaggctcaaagagatgaaagtatcctctgagtatcacagccagaaacaaggcacagacggagctcttctgcctccctgctcaccatccccaaatccccggcctagggccctgcccagccccttccagctgactctgctccttccactccaccctgaggccaggctgggcagccacagatgaaagctggaccctgcccccacctgtggccaccagccccagccagggccctcgtggacctcgggaccccacctggccggctgcagcccctctcacctgagcagcagggaggccctgcattgggccgggcagaccctgggccggctgcctgctccttgcctttctgatcctggctgctcaaggcctcaactgcccggccctcagcatcagccatttccccgccggatgaaaggcagccaggcttttaggtacatgaaagcggcacaggcagggacgtgtagttcagagaaccggtcagaggaaagaaggcctggcctgcactaggtcagggctgagagacaccatcccccacctcagcaccccccacccgcctgagccacacacagtctcccaaggggcatctgctgcagacgcacagcacccagaggagcaagaggtgttgccagccacctctcctccctctacggggcctcaggagggagtgtgtctccctccgagctgggcacacggtaagcacttcacacgctctagtggggcaccaagcacctcctcttagccgggtgctgaggaccagcctggtgggggcgggtaaaggtggtcctcagagggacatgctgtctccaggctgacacgccaggtttggggcaacgaggggttcactgggggcctcgcagaggagctgtgtgagagaaaaggtggacagtatgggacatgggcttggacgggccgaggaggtgcacagaggggaacacaaggtcaaggaggttcaaagcagctaggcagagccgtcacagtgaaagaccagaggtatgggtgaggggttcaggaagacataagaggatcaggggcaaggggggaggaccagcacatggagggggtatggatggcccccccggcctcagccctgaggtggcctacttctaacaaggaccccagagtataagagcaaaagagtgaccctatatcttagggcccccctcaaaaaaaacagaggagcagacttccaaggcctgggaagtgggcaggggcaggacggggcaccctgggcatgagactgaggtggcatctgggtcatctttggaaggattaggatagacccaggtaggcctgtcccataagccaaaggccttcccctgtactcagtaggtcacttgggggctgctggccacttcccctcagatcctctgggaatttgggtcaagctggcctgcaccacccacttcaggatggcctcatcaatcagacctcattaccctgctctgcagacacagacccgccaccaactcccagccccaggtgtccagccactcgggggcctggccatgcaccccaccgggccctgagccagcctgtgcctcagtgctgccagtcactcagcgctgggggctgcgcccacagtctccagtctcggtgtccatctctgctccccggggcactcggcctccctggccccgccacccccccaggcctggagactgggtggccctggccctactctacctttacacggacccccttcctctcacaccgtgccccatagcgtctcctcactgccactaagcagtggacatgactctcccagaagacgaacgctatcttaaaagacaatcaaatttgcccatgggacccccgtgtttcctctgccacggccgctctcggggccaccagccttcccctcccccactctccaggcctccccgcactcctcagaaactgttcattcacccacccaataaaggtttacccagcactcactgtgtgtctcgcccactcttcggcacaggggtgagcacccagagacacatccctgctttcatggaacagacattctagcgagaggtaacaaacgaacacgcacacagttaacgttgtcctcagagctgctggaggcatctccagctctcggccttcccgccgcgtggtcaaattcgactccctgacccttatggttggctggggccgtgggccacgttctggctaatgaggcgcaagcagaaaatgccattccttcggagccagagcatttcactgcagttgtgagaccctacagggtccacgttccctctgctaccaagaccagcctgggtccctggggagacggggcggagcactcagccaacccacacagagctagtaagcagcttgttcatgcattttaagccacagagcctgaagggtggtttgttctttcagcacagcctcactgatgctgacgacagtggcaggagcttcgggacagccaggcatgagtcttctttatcaccacctcacgagcctgggcatgtcaagttcccattcggtacatgctggcttgggctgaactgaattacattcacattcacacacacacacacacactcacacacactcgcaatcatcatcaccgtgaaaactagcacttaggagcacctggggggatcagtgagtttagcatctgcctgtagctcaggtcatgatcctggggtcctgggattgagcctcagattgggatccctgctcagcggggagcctgcttctccctctccctctgcccctcacctcgctcatgctctctctcaaataaataaataaaatcttaaaaaaaaaaagaaaagaaactagcatttattgagtttactatgtgccaggacctgtcctcagtggttacaaatgccttcacatctttgatcttatgaaaagcatatgaagtagacccttttattgttcccattttcccaaaactgaggtacaaagggattaaaaacttgtctaaggtcacacagttagcaagtggctgaggcaggatttggacccagagggacaagttccagagcccagtccactgtcatgtaaaaccccagcctcccccttgtaccggttggcccagacatacgtgtgcgtgcacacacgcgcacacagagtctgagggtgtggctgacagcctccagggacccggagggctgcccacaccctctgcggggcagggtcctcagggcagcaaccgaggaagccacccctgctcgccctccatgcccagtccctgcctctcctcctggctgtcacactctcggctgaagtggcccatctgtctccagcataaaggatcaagcagaggtgaggctggggccctagagggttgtataaatggctctgctttgagcaacagctaatttctaaacacaattattaatttcatgcttatcatatgcaaacctctgtctcccagacgagatgaaattgatttaattagaaattccatcatcaagcctttcggatccaagcttttaattaggatcaccaaccccacccaaggctgccagaaagtgtgccctggcccctgcttctcttcctgaggccccaggcacagccaggatgtgtgggccactccgctgtcagcagggccccaccggccaggtcagcgcccatgacctatgtcccaccccaaatgggggacatggctccacagtcaccagcagcctctttccaaatggcatcataatgggggaaacagcttggagagaactcgtatcatcttgcagcaagaaggactggggtgttaaaggtgagcaggagacaggagatgaacagacctccactcttcatgcaaaattcacatacggcctccctttggagcacctgccaggtgctaataaaatgcctttcacagcttagctcagggcagtcagtcaaaattatcaatagcacttggcgttttatcaaagcatttccagcacatgacctctgacctcatcccaccttggcctagcttgtgttctcggggccccagtcacacaggtctccttgctgaaccctgaacatactgggcacgctctgcctcagggcctctgtgctggctgttcctctgcctcagtgctcttctcccaggcacaaatgtggctcactccttccttcacatccttcccttggagagactgctcacatgtcaccttcctgggaaagcctttcccaacctcctaacttagtacccatgctgcttccagacactgcaccctgctgtcactgcccttgcttggattttcccccataataacgaccactttccagcacgctcaacctttacttacttttcacttaacatccacctcctcctgccacgtgagctccacagatctggggaccttcctttgattccccacggggtgcctggcgcagcacttggcacagggcaggtgccccatactcaaaggggctccttcattcctgccacgtaagtggcccgaggacaagctcacgatctcacagacgccttagacaggtgaggagacccaacctcacagcccaggtcacagagccggccaggggctgagttccaattctcccgtgctccgatgcttgacctggacaagcaggccactctgcaccagtgcctggcacacacagatgctgctctgaggtctccattctccctccccagggctcagcaggggcatccctcacttcctagggcctgccgtgcccaattcctacccccctcggccccctgatttcccagcaacaccctagaaggcaatcattgtggggccatcccacacccacccctgtctccccctccctggagcccacctggactcttatcaggacagcaaggagacacttggattaatttccagaatggttctgaattatgctttccaggagagaacccgacagatgcaggcaacaggcctttgaacaaatatttccccagaaagtgctttattcagtcccttgtctcacccctttaaacattatgtgttttcttgggagcccaggaaaaagggggctcaataaggcaaggaggctggagaagaagagggcataggggtagggtggtggggggcctgggagggacgctgacaaagaagctgttcagatgcaggggtggagggcctgcatagataagagcacaggcggggaagcaggcggtgcaagggcaagagcaaacaagatcctcaaatcagcacttgtcctatttcataagcaaaatgtagatcaataaattacactcacttttacaggttttacatgctgactccgtaaccttgtcaagagtgatacttacggggggagactagggggtggaggagcccagagacctagacaggaagggccagggacctggtggagcccctggggccacagggcctgcacccctttttccaagaagggctcaaatcccaagttcgcagaggcaaggaaacaggctgccacaccctcagcccactgcctcgcttggtaaccgtgggcaagtcaccacccctgtgagcctctaacttctcatctgtcaaatagccccagcagtgagagcctgggctctgtaagccttactgtgaggctcctatggaaggagggacgttaagtcttagaaagcagactaagacgctagaatcatgatacctcttgcacacacgcacgctgggtacagtcagcctatacagactctcctttcgttgattctcaccacagccccgagacagggagccgtagccacatttatatgaggctcagagggctgaggggcatgcccaggatcacccagacccatctgggtttctctgtgccacagcactgcccagaagccggggagctgggcagcactgggccatacccacgtgtccaagggggctcctcagacaagcccagggtggccgcagctggcacccgtaatgggctcagcagggactgggcatgggggggtggcaggcagcaggcaagaggctgctcagtgttggtggtggtcataacaggcctggtagctgtgccttcatgagcacctactccacgcagagcaggtcacggggattatctcatttaatcctcacacaataaccccatgaagcgaatgctatttattaccttcgctgttcagaagagtaaacagaggcccaggaaaacacagaaataaaactagagcacatggcaaatcaggacctgaacccaaggtctgactccagcccctgagagctcacaagtggccacaccgggcaggcccgccacgttcattgccaggtcctgccctttatccacaccatccccacatgggggcagggggcggcagccgggatggggagtccagggtcatgctccaggtctctccccagcacatcctgtgagcacaatgctttgcatctctgagcctcagtttccacatctgttcaaggggacagttaatgacccctacccactggacttataaggttgggacagagggaggggcctccacaacataagagtgacatctgcccacagccaccagccctgggaggtggaggcgaggccgggacagcgtcagccactgcggcgtgcctgaggctccaggaattagccctgcgccccaccaccccgctcctgcgcactgagcaccagccgtggggcacagcccagctaagggaaaattacccacggcgtctgccccagtgttctcccaagttaatgcgctgtgccgtgggtaatatacggctctgtattaatataatatgatataatgggatgtattaacattattgaatacatgagccgataaaagtcacatcaccatcactccgtgtaatttatatcacagcctgggccagagccaggctggcggggccggggaggccccactgaagctctggggctcctgctgggggaagggcctgacccctgggtgggggagtggagccaagaccagagagaaagggatgtgccaccaagcaggcaaggccaggtgatccccgggccagggtgccaggctatggtctgggagctcttgacctgagccctctggccagtcctcaagcacttgaccccacagcgacatctgacccagcagtccctccacttggctgcctggctccttgctcccctggggtcctccttcctctaagacagcacctcctcagcctccttggctggtcctgaaggccagcaaccccaggactcagtcctccatttcctctctctccactcattcccaggccacctatagcctgatgacccacccccaaactccaggctcccacccactgcttgctcctcttggctgtctactgggacccccagatccccccaaaggccttcctagccaggatcagacacatccttgattcctctctctcatgacccaaacctgatttatcaggaaatacttttggctctatgaggaaaataaatccagaatccaaccacagctcaaccatgctgccactaccaccctgggccatggctccagcatctctggcctggactaacccagcagcccccttccctggtcccccaggtcccatacttaccacccatctcatcacccattccttggctagcacccatttaaaattcaagttagggggcacctgggtggctcagtcggttgaacatctttctttggctcaggttatgatcccggggtcctgggatcaagtcctgcatcaggctcctctgctcagtggggacctccttctccctctccctctgcctgccactctgctggcttgtgctctcttgctctctctctcaaataaataaataaatacataaaatctttaaaaacaaaactcaagttagatcatgtccctcctctcttcaagagtctcccatcttgggcagcccgggtggcttagcggtttagcgccaccttcggtccaggatgtgatcctggaggcccgggatctaatcccacatcaggctccctgcatgaagcctacttctccctctgcctgtgtctctgcctctctctctgtctctcatgaataaataaataaaatctttaaaaaaaaaaaaaaaagagtctcccatcttagccagagtttaccaggcccaaggaaatctgcccccttagcctcctgacctcaccacccacccctctgtccctcacttgctctgctccagccactcgggcttcatgctgttcttcccaacacaccaggcaggagcttgcctcaggaccttggcactggctatgcactcatcactgcctgttgatactatacattccattcatgtgtcctcttgaccatctgcctcaccagcactgcccccagtggggcccagggtgagcaggctgctgagcacccagcctgcaggtggtgctaccaccctcctagggcttctccgatccctggctcccctcactgctgtcctcaggcaccagcagccccttactctgaaccatcatcttcagcaccatctagaaggggacccacatgtggcatactccaggtggtatcccaccccaggggtccttcttgggggacatttgttgtggaagtcccatctcagcctacaaaatgaaggcttctggtccctggcaaaggtagaggtggtatgggcttcccaccacatcatgcactcattcaaaatatgtttaccaagcactcactagtgtccagcactatgataagcaccagggatgccagagtgggcaaaagcagacaaatatctgttctcatggagctgagtctagtggaagaaatggcccataaccagatatgcacacctacacatacataatcacaacctctgagatgtgctgggaggaagaggcaaggtgcctgtgagagccttgaatcagggcctggatctggtcaggggagccaaggaggcttcctgaggagaggtaggaatctgacatccaaaggatggacaggcaatacccaggtgaagagggaaggaaagagcattctgtgcaaaggccctgtggccaagagcccatggcagtttcaaggaaaagcaagaccacaaagaaaatgggagaatagagcatgagatgcacctgtagagaaaacagatgtggggacaagatggggaccaagaacagcagtgggaaggccaccacactggtccaggtgcgaggtgagagcagctgggccagggggtatccgtggagacagagagaagtatgccctcccacaagctctccagctcccgaatatctccctccttgtgacacttagtgagctcttcactaaactccaagctcaccaaaaaccagaggaagggcctggagctgaaagactggcaaacggggtctcgggtgcctgcctctcctcagagccaagcccattcctccaagataagcaggcttcccaggggttctccagctgccccagtgacacaggcagggtgaggaggcggccagggtgtagacacaaagcaggaaagggccaccctttgcctctcacttccactgccatcaccccctacctacagctctgtgagcttgccacgatggaaagaacctgaattcatcagccaccaactcactgcatggcctcgagctagatgctcctccatctgtgctccaggtttctcatctaagaatcgtaacaactacagtaataacttaacacgtattgagcgcttactatatgccagactctgttctcagggttaatttctttactcctccctagaattctgtcacagagatactagcattcagcccatttcacaggtgagggaactgaggtacagagaagttaaattacttgcccaaagacatgcatctggtaggtggccaagcagggacttgcgctcttgcagccaggctgtcctgcctccccaccgagataaggactggatggaatcccctctaggaccctccaaactctgctgtggctgcctcctgggatctcagcccagagatccagcctccagccggcaactccggaaggctggcagcttggacttggggtggatctcaccccagacccttctacttctctctaccttctgcaaaaacctccagatgttgcattctattcagcaagcacgttccactggcccacagtgtgccagatattaggacatggtgggggccagcacggtccctgcccagtaccatggacctgctctgtgccatgtcccaacagtccccaggggcatgggccctggccaccactgagcaaacctgctctttaacacacctgcctggctcctccccttgttctcacttctcctctatcactggtacatcctgaggtcacctcgaggggactgaccccagatagaactttctaccattccctcacttaatttactcctaacaaaacccttccaggttccattattatctgcatttttaggcaaaacttagagactgggagagaagtcgttctccctctgtcactcagctactgattgaaacccaggcccaccaatgccagagacagagcccacggcaggaaccaccagcacgtctgggtcctgtccagataatgaagggacaggctagagatgcccacaggctctccctgtcccagcccgacgtgttcagtttccagaaactggtaatccgagctgacacggctctctgaaagggaagctctgagtggatcttgggcccttccaccctgtctcactcactcaggcccctgcctcaggatctctggggtgaacgaagctctgcccattaacccaggcctcagcaggtcccactgggggcagcctcgggtagcagagcctggagaaaggtcctgccaccgtcatagctgggaaccccaggccctctctcagtgccaccaggcagcagggtaaattcagaggagcacgaagctcacctcaagttcccaagcatctcccaactcctgccccacaggccagaatccccatcactgggatcaaagtggccttgccagggacctgtgcttaccatctcctagagggagcccatcccaactcccaggcttgccaggcttttcgggactctgaattgaaatctacctctttgtcactttcatgtgcttctatgtagttctctggagcagcaaacacccagcctgtgcccccagctggaaggccccccagggctccttgactctactatatttacacccctacttgcagccctgcttgggcttctggcctgttctttgtctggtggtctaggtctgcacgtgtacccacatggacatgcaggggcacagtggagcacacccgggcaggaccaccactctctccccaacatcccccccagcccccagcctcccccttggaaggaaagcccaagccctgtgtgagccctgctgccttgctgacctcagctcttaccaactgccccactttactcctcaaacagcccctgagcatcgagcactgtctagcctcagcctctgcacctgccatgccctctgcctagctggcttttccccccacacagccacagagcatactctttcactctatcctcgtctctgatcaaatgtcaccctctgggatgcctgggtggctcagtggttgagcatctgcctttggctcagggtcctgggatcaagttctgcattaggctccccacagggaatctgcttctccttctgcctgtgtctctgcctctctctctctctctgcatctctcataaataaataaaatcttaaaaaaaaaaaagtcaccctctcaaagatgctgtcactcatctaaagcagccccacctcacaccctgtccccttacccatggcccttctcaccccaactatatataacatgtctctcttcgagtaagtgtctagctgtcttttggctgtgcctcacaggattggcagccccaacagcctgagagccacaggggccaaggcccccaggcgctggagatcacgactgcacccctcccctggccctggctgcaggccctgtccttcactggactcattcctccaacttttttttttttttctttttttcattcctccaacttccatctgaagataaggaaggccctccagggcaggctgtgggtgtggagagtcaggagcccacaggaaatggcccctctccaaggggaccctgtgaccacaggagccaagtggagacagtcttctccacggtcacccttggggctgccgtggccaggcggacagctccagacagtacaatcgcacggtccatagtacctgctgatggtggcaggggccaggaaggaggaaacacacatacagatggacgtacaccctataactcagccctgccaggcccagcagactcagagtcagtccacccaaatcgaaggacctgcacacacatgtgtgccacaggaatatcccagaaaggctcactcactcatgtgagtgcgcacatagacacacacacatacacaccccactctggtacagtctggtggaatcatgatttacagcacatttggggagcacaaaagaatgttcatcccccaccccggaaaagtcactgccctgcccaactgcccattaagcagctggaattcttaactgcccacatgtgagcaggaaaagtgctgacctgctatcacccattaacacccagcaggtggcagtttttctgcagggctggagggagccagtgggagatccagcctggcagccgcagagcccaaggtgggcgagagctgatgggccgggaaagggtcagaccaggcagtgggggggccctggcagcagaggaggattgaggaactgggcaccagcgtggggcagcccagaagttgtgtacccacctactatgctcacctgcccatcttgctcccacagataccacgggtgggggctggggttggcaggcctacctcctgccccaggccccaacctgcccaggtcattggcattgccgggagtaggctgtgctggcaagcaccctgtgctcatctttctggttgtccagatcgcccatgaggctgtgaggacatgaaaactccaacaagaaacaaagggaccttgtgtagagatcctacggtgaggaggcccttccctcaacccaggttgcacctaaatacccatagtggaaaagcaggggggtggggggcagaatcactccctgtaagccaaggcctgctccagcctacggaggagagggcagtatctgtaatttgttttaataatcctgctgaacagggagaaaattaacaaacgagaaaccagctggaaattaatcaaacttctccctgtccatccccccaccttccatcttaatgaaggttatttatccaacgagcaataaaacatggaattaaattaaacaggccttttcttttggtgctctcccccgccccagggaggcggtgtctcctgcttacagctctataagccgggccacggggaggaacacggcggagccatgattcccagatgcctatcacaggggtttccccagaaggagcccctcaattagcacgctcccagtttaggtctccctgccagctctctgccaaaaatatgaacggcagttaactcaaccacccttcagagatgggacagagggaggttcctgtggttagatgggggactcaccagcttccctgtggggaagagaagggcctggatgtggaagatggggagcatgagcatccccccaaatgaggatactctgatgcccacgattctggctggaaacaccatcctggccccaacctcttggtaggaaggggctggagggagtgcagggcacagaggatgctgaggaaggacctcccttgaggacaggactcagtctccccagctcagggcacaagcatcacaggtcagtgtacctgccctcgggccgagactgcgccctgtaccctcaatttcctctggcagtttcttgggcagctgagtccccaaatttctcctcacagcctttaaatccacttatgcttctgtcaggccatgtcttggagtcacaggttcctaaataactactctcagggtccctcctcaaccaccctctttggtcttccctctggctttgaaaatgtataataattgccttccatttacagctttcacatacattctccctttgaaacctcacatcagccaggtgagggtttttcactgatgcccacttaacaggggagaaaccctgaggctcagagaggaccatgggcaaggtgcatgtcgctgtggctgggggtcctagccttggtgggctggggcttggggaccaggggtgtggggcaggcagcagggcaggggtcttcagaattgccaggtccctgggaagcctcttcaggcacttttggtggaggacgactgggaggtcgattgctggcctggaaggaggggaggcgagggaagaggggaggcaagaatggaagagagagggatggatggaggatggagggtgactgcaaataaactgctctaaactggcccccccgacaatgctgcaaatccagtctacacggggcagccagagagcaccctggaaaccatgcaaaagatcccatcattctctgcttaaaaccctccaaaagggaaccctgggtggcgcagcggtttggcgcctgcctttggcccagggcgcgatcctggagacctgggatcgaatcccacatcgggctcccggtgcatggagcctgcttctccctctgcctgtgtttctgcctctctctctctctctctgtctatcataaataaataaaaataaatttaaaaaaaaaacctccaaaagctgcccagaacaactggagggaacagtccaactctgtcccaggacccaggagtccctgctggtccagctgcgccaccccttccccacctctctgaacagcatgcttattgttcctcaaatgagccatgagtatttctgcttccaaacctttgcaccgcctgtgcccttaacccaaacaccatccagccactggctcccttccttacttgcctgcatctatattcaaacaccctctccccgaccaccttgtgtaaaatagccttctctctcctcatctgtctcaaaacccctgacctgtacgctgttcatccacagtgcctgtcaccatttgaactattgctcacctcatttactatcttctccccctctagagggtcagctccatgtgggcaaggagtgtatgtgtgtgtttcttcactgatgtattcctaacctagcccaacatctgactatttggtgaatgaatgaaggaatgaatgctcaaggccattatttgggccatcatcacctctcgtctgaattgttccactggatcccaatcactctctcaagactcaggcctcagcctacaaccaaccttccactctacactcaaaggaatatttctaacccccaaatccaaccagggcactgttctacaggatcaagtccacactcttggcctaagcccccaacccaccccagcacccccctccacttatccaccacccaaccctctccccccaatgccacaagccttactgatccaaccagacatatctgaagttttagccctttccacttagagcactctcatggctccctctctgcctacaggatactgaccacctcctctaggcagccaccctatgcatgccctgtcagaagtgacttctccctcctctgaaaccccatagaccctcacttgcacctccaccacagccgtcccataccccaacttaagctatgacaaatcacacatatgccacacctcccattccaggaaggacacagatttattcactctggcaatctctgccatccctaccacctgctccagtagcttgcacaaactcggagctccataaacatttgctgaatcaaactgaaccagttcaaacacagtccagggagagtgcccattaagaggggtctttcctccagtttgctggcatttcaggctggtctgaggacaaacggacttttaagtacctcttaattgcagcacatgggagcagctggccccacattccactaacctctccttgagggatgcctgagaagaaatcaattccccagggttgagaggtggccagggccctgttaaaacggcaatgcacggaatgagcactgggtgttacactatatgttggcaaatcgaactccaataaaaaaatataccaaaaaaaaaaaaaaaaaaaacggcaatgccctgcctccagtccagcccataatagcagctcctggtccacccagcagcctgcatatatgagcacaagcatggccacccccatgggtgaggacagcaggcacaacacagccactgctgaattatttattccttacattgttagcacagtagagagagcaaccgtgtctccaggcttcaattaaaatatcaaggcactcgcaccgtctgccgggccacatgcccagctcccaccaaaactggcaggatgggaccgcctgggaagccagaagctccccaaggccaaccctgctgccctgctttgcctgccctcagccaagtcctgtgtctggaccacagacagggacccctcctctaggggtctgcagtgaactttaacccagaggctgcccctgaggcccctggcaaaaccgtcagggctctaaaagaccacttagtacttcagtgacctaaaggagactctctggcttcccaaggcggccctgggacaagcctggctgggtttgaaccttactccaattctctatcagctcccagcaccccccgaaacacttcacagcctgtggctgggaggcaggagttcaaggctcaccccagctcttctccagcctccacgatgaactctggccacatcacaccacctccctggactctgctttccttttttttttttttttttttggctctgctttcctcactcagaaaatgcaaatgacgatgcccaggctgtgaccccatgggagcgtcacaatcactggagaggggcttgggaaaagtaaaatgaggtataaatgttggccttgctaggagagggctttcatttcagaagagtgggttctacagccttgccacccgtaccccaacctgaaaacccctgattctgaggctcagactcaggaggaaaaaagggctggcaaagccaggagctggctgggtcacaagctaactaggtcacccacaagattcacttcaacaacccccggactggaatatgaggccgagtgaaatcaaagtgggcgagctgaaaaagaacaagaaattgcaaacacatgccgccaagaacagtggaatgagcacaggtttcggggacaggcggtgctgcaggcctccgctacgccctggacaagcccgcttcctcacctgtaggatttcccagctggtcacttacattagataaccgttatgaagctctgactcagtgccaggcacataaattcaaccatgggtgttattaagcacctactatgttctgggccaggaggtagagcagtgaggaagagaggcagaaccgtgacttgcagagcttgacatccgaaccatcactgttatccatcaagatgatgacagaggtagcatttgagatgggccttgaagcacaggagaaatttccacagcaaaaaaaaaaaaaaaaaaaaaaagggatccctgggtggcgcagcggtttggcgcctgcctttggcccagggcgcgatcctggagacccgggatcgaatcccacatcgggctcccggtgcatggagcctgcttctccttctgcctgtgtctctgcctctctctctctctctatcataaataaatttttaaaaaaaatttttttttaaaagtggcaagaaggtataatcctttcggagaattgtttggcagtacctttttgttttttgagatcttatttatttgacagagagtgagagagcacaacagggggagcggcaggcaaaaggtgagggaaaagcagactctgctgagcagggagcctgctacagggctcgatcccaggaccccaggatcacgacctgaactaaaggcagaggcttaacagactgagacacccaccctgtggcactgtctttttaagctaatcattcatttagctgatgagccagcaattgtgtgtgtgtgcatgtttgtgtgtgtgttcatatacatatatatgtacgtgtttgtatatgaaatgagtgctcgtgtccactaaaagacatgtctacaaatactcagagtacctttattcataatagccaatcactggattcaccccagatgtccagcagaagcagaatgggtaaacagttatgaaccaggcaaacaaccacacaatggaatagtatggagccatgaaaaagaaaaatgccaattattctttcatctaactacatggatgaacctcccagacaatgtgggtgaaagcagccagatacaaaagacttactgtttgtgtgattctgtttataagaagctcaaagccagatgcaagtaatctatactgttagaagtcgggctcgattagccttggggaaggaaggatatggactaggagaggctcaagggaacactctagggtactggaaatgttctccgtcttaatgttcatacaggtacatgcatttttgaaagcgcatcaagtagtacacctgaaatttgtgtactttactatatataagttatacttcaattttttgtaatgtagaagaaagaagaggtggacagagtattcttcagggactgagggaacactagaagcagaagccagcagattggactttaggaggcataaggagtggcacaggggacctggagcaggagtgacagcggccagagggaaggactagggtgaaggtcggccggatgggctgctgaggcaaagccaccctgggagcccaggggcttccacctccttctctgggcaccccctgccacacaccccacctgtgcacagcaagtggtacaggtgaggtcattccccctccctgccagcctgtccccccacccccacccccacccctccctcagccaccaccctgaatcggaatccctgagtttaatttctggggcttttgggaggctttcatcctgagcagaaataaagtgatagccacaatctctcacccccatgcctgtagttcagccaagcaggtttctccaggcccccgtgtcccacgcccacagcatcactgaggacacctggctctgcctcctacgctccacctgccatgtccaccttcccatctgccctctcagggagctcacctgagcacctgtctctcccaggataactggtccaattaggtaggaccctcccaccttctgcttcctaccacccagcacccaagccttcgctatcacatcaccccttggagagagagagagcactagaaatgcacggctgagggagcagccaagaaacctcacaccccacccagccaccagtgagacatagcacataaaagggccccctgatgggggattacggagccattacacaccatgtttcaaagactatttaaggatagtggaaaatgctcccaactgtagtctggtgggcaaaagctggctacagaaccacagaggtgttattgtctcaacctcgtaaattatatataagagaggctagaaggaaatacacaaatgtttcaagtttgtcactctggatggtggaatgagtgggcaattttcattcgcttctttatgcgcttctgctttcttccaaatctgcaatgagcacattggcttttagaaggagtcggaccatcaggccacactcacacataaggaccccggggctgatggtcctacgctccacagggcagaggaagacctacacgatgccagactgcaaaccaccttcagcaccacccacagactcccacactaagacaggtggcctcaaaggacctgcatgtcacatccagctatgtggaggggacgggcacaggtctggggatctaggaccgggttttttgttttttttttaagattttatttatttattcatgagagacacagagagagaggcagagacacaggcagagggagaagcaggctccacgcaggtagcctgacatgggacttgatcccatgtcttcaggatcacgccctgggctgaaggtggcactaaaccgctgagccccccgggctgcccctaggaccggggtttaaagcccatctctgattctgactaaccaggtggtctccacacattaacttctacgggcctcagtttcttcctggaaagtagggcatctgttctgagcactctgtagtaccatcggcctgtggaataaccaagaagggactgtgaaaggttgtaaactgtcactggttgtaagagaccctggtgtccccattcttgtttttctgtttttcaccaggccctaaggccctaccacggtttctttttttttaagattttatttgtttatttatttattttgtttatttatttaagagagagagcatgagcagaggcagagggagaagcagactccctgcagaacggggagcccaatgcagggcttcatcccaggaccttgggatcatgacctgagccgaaggcacactcacccactgagccacgcaggtgcccccctcccatggtttccaagaaatgctcagaagctgcctacagcaggtgcctgaaagttccccaaatcatggaccgtacccctatgctgaatccgaagctgtacagaaaacatacgtatttttaattaaactggaaacccaacaaaagctaaggaaaaagccacttcctccttcaacactgccaaagaccactgtgcacactagaacaaaacccactcacttcatctctatgaaatagggaaaagttcagtgtcgaagcattcttactgcctaagttctagccaactctgtgctggatttccttttggaaaagaggttcggtggtttgtttttttgttgttttttttttttttcacgttgacatctttctgttaaaaatatttttcagctcatctctctagattctatggggactccccagaagaaataggtgatatagtccctgacttcagggtccctctcttggtggggaggctagagggaatgaaagctttaggggccagcacagacccaggtgaggactggtgtgggaagggtctcaggggaggaggtttgtagctggatatgaagagcggggaagaataaagagggttttcagtaggggaagccacgtctcattcaaagggagttcggtgaattatgtagaattaatataataaatatgtacaatggctgcaggtgacagcatctccctgaataatttggaggggggagaaaggaggcagcagagcccttgattcttcagaggaagtattacatggaaaatccacatggaaaacaagaacagcttcaagccccccaaaagaagaattctgaggcccctccaggaagaagtaagaaagctcctgcctcactaccctcagaaagtattcagtaaaactgggtcttgatgcatcgcgcagatggggaaatggaaaggcagacagtctaagtgatcttgtcaagggcccaaggctggttagaacagaaggggggccctccagcagatagtgtctaaaccaaggtgcagacggaggataaacataatgtgcgggcctgggccagaagcactccttggggagccagagaggcaaaggaccagccaaactccagccctgagccgctgcgggacccaaggagtcaccacccctccgagccgcgtctgttacagggatacacaaggcagccgcagcgtccaaagacagcagagtatgggcattgagggttttactaggggtaatcacacctgaatgatggggggtggagggaatgggtggacagatggccagccgagccaggccagcaatggtcacccccgctgctagttctcagcaccttccgggacctgcagagaggcctagggctgcctccaccccaccctacacagactcacagtgaagagggcgcactcactcctctgagcctctccttagctaaggactgaggtccctgctccccatgatctgctacacaaggctgcacagaggccaggtcagcagcaccagccacggggcctcctcccagccccacccagctggcagcagaggtggagaccaggccccagggagtccaggccccacccagggctggcaggaggccatgagattacaaatacactggccctctgacccggcactcccactccactcccactccgtaggaattcgccccacagagatgtgcaaagcagtcaatgacaaaggcagccatcatgactctgttcacaaacgcacagggtggggaaccacctagtgtccatcaccaggagaccggaagcagggagtactggtggccatgcaaaggacaagtccttactcgctgatcagtccccaaggtcacccctgctgcagtcatgtgaagacagtggaggagaacacaggtgtacacaccttgccctgatacactaggtgaatggtgcccccagcgtgtgccatacggcagccccaagtccagactcatgccctctttgaaaggaagcagtggctgcctccatggtggggctggggtatgtccctcagtacctttgaatacccatgggaaagtatttcacacttaaaaaatactactacaggcctagggggtctggggcccctggataaagggcacgttcaggagagagaagcatctccatgggagatcctctcaggcaccttcacctacaatctctctctctgcctacccccctacccctccactcatcctgtcctctccccctacctcccaaactgcttgagagagaagccaggactcaaggccaggggggccagcacagaagttggggactccccagcctgatgctagaggggaatggacggggtcctggtccaggctgacaggccagggccgaagccaggcccaggtgagcgtgggggaggacaagcaggggagggggctactctccgtcggttgggtttgttgcactttcctaattgattttatgtctgtgtccccaggatacttaggaccatcttagaaaccacttaagcaatttaaaataatcaaagtacttagaaggcacttaacatttcctcacacttcaggcttcccataaaccccctttcagctgcaacctgaggcctcagtcaggagaaaccactgccaggaggtaggtgcctatgtcaggcccctacctcctgccatgtcaccccaagcctcagcagtacccgaagcaagacagctgaccccgacaccagcaccaggctctctctctcaccaccaggccttcggactcctgggtccctccgcctgcaatgccctcccctgctgcccagcacagacctccacctacctaattgtatcctggctattgagctagttgtcctcctacaggaagccctccctgacacctcccaccaagctgaataaggccatctcatctaccccaattaaagcactcatctgtcacacctgggtggctcagtggttgagtgtctgccttgggctcagggtgtgatcctggggtcctgggatcaagtcccacactgggctccctacagggaccctgcttctccctctgcctgtgtctctgcctctctctttgtgtgtctctcatgaataaataaataaaattttttaaaaacactcatcttgggcagcccaatggcccagcggtttagcaccaccttcagcccagggtgtgatcctggagaccggggattgagtcccatgtcgggctccctgcatggagcctacttctccttctgcatgtgtctctgtgtgtctctcatgaataaataaatacaatctttttaaaaaatgtttctttaaaaaaaaaaaactcctcttactgtcatgaaattactgaccatttgactctggagtcaggtgtcttcaccccaaccccaagtttcagaagcatggggcatggtctgcataaagcagagatctgtcacgtttgttgtgtaaaacaatgaatcaagcctgacatcacagatggagtcgaggagacacaaccttccggtggacaacactagagcctgagtcctcagttatcctcatccccattttatagaggaggacatccaggctcagagagatccagcaacactcccaaagttgcacagcaagtgagcagcagacccagaggaagcacctccaaatgcaagtccacaaggcacccgggagcttgatgaaacaagacttcacaccctgagaatcctcttagcaaggctgcgtaggtccaggcacctggtgaaaacgtgtgttctaaccagcaccagaagggtccaatgtggaggcaggtttggaaaccagcattcctgcataaaacgtagagagcaacctgccaggctctgggaaagttcaggaggcttattccccacgagtctgcaattccactcctgggtgtgacctacaagaaactctcccaagaacacaaagacacagtggccagctttgtcgtgcagcacccttggtaaaaaaactaggaagatcatcaggaaccttgctaggtgtccacagtcaacaaacaagaaaatgaacagggtgctgttccaaggggggggagtatgtggccaaggaaaagttgaagagcaacatgatacccagatcccaattttagcaagcttaaaacacgcaaaacaaaactatttttaagtgcacagtaactgaaagaattacaaacaatccctacaggacagggcagtggctgcctctgaggaggaagcggaggagggtgcaagacgcacacatggagcctctgatgacatctgcaacgttttcgttcttaaaatgaaaacaaatgttgatattattagggcaaaacatcagtatttgaccaagccaggtgttgggtacagagcagtttattaggctctctaattctccatatgcttggaatttgggggtaataaaattcatgatgccttgtgagagagagagagaacccctttcctgccaggctcctgtggatgatgccactcacctttgataaaaggctcctttgtgaatgctgtgtgctccccacttccctcacctcccctcagaacagacctgattctggaagccatgtccctcacacacctgggggcagggcccccaaatgtcctaaccctcaaggtttcccctgaggggaggagtgtcctttgcccacattccttcctaaggatctagctttgctttctatctgccgctatggtgcaggggcggggatggggagagggggagacatgggactggattccctgacagctctcaggccccaattccaagggagggaggcagctgcactgaacacagacacccactgccctgaccgaggttaatgctgctgggcctcccctgaaaccacagaccacaggggatgaagaatgagctaagtgctgtctctctactctgcagccctagccagagacaccagaggaccatcagggcccctggctgctcctgctcagcatgggggtgctgctcagcgggctccctccctccctccagcatatttcagccttaacaattttaaattcctcctaggcccctggggatggctagagaacaggctgccaggcctgcttctaccttcctgcacctgcacttcacacctcctgtgtcatccaaggggcccctctcagtggaccccaggaaaaaactaaagcctgggtggggaggactcaggcctgagaggggataaaatagggggacagggggaagaatccagcctccctctcatgcatgaacaaacttcacaacagttactgcttcttgagggcctaccacacgctaggcaccaggccagtcaatttaccttgtcccattcatgctcacaaccgtcctacccattttacagatccagaaacaggctcaaagacgttctgtgaccttccctgcccgaggtcacacagccaggagtggcagagccaggatttgccctgtctgaagtagcttcacatccctgcaactgaccaagtgtccccaccaccctgggatgcctgcagagccagcccacggtcatcccaccggcaaggggggggacgacaacgacgacgacgacgatctgagtcgggaaagggggcctcgaggggtttggtgcccaccaggaggctctcagtactgagatatggatggccatcatcaaggcgggcaggtggtcagagtggctgggaggctagggcacacctgtccagcctcaggtgagctgctggccagtcctacctcttggccttaactgtggatgaggccaccacatgatccagggagaggcccaggcagagccagagaaggtggaaggaaagggagagatgtgggtagaatatgagggaagcagagaaagccacagggtcccacagaatgaggcagggactggagactaagggtggccctgcttccctccccccatcacagctcgggggtaccgctctccatggcagccccaaggcagaaggctggggcccgcatctcatcccctcacccaggccaggcccctgagaaagggcaagcctaaaggtcacctggaatataacccatgtagaccttatttcatttccaatatgtctgggtcataaaaatgctagtttaataaattgggaggaaaccgaaaagacacagctcattcagggctgggcaggggaggtaccatgagcttaacaggtctgacaatgtgggtcccacccctccacagggcccactccctcaccaggttccacacctggtcccaaggctgacggactccctggcactgacagggcctggcactggggtggaggggaaggggcctaaaggtgggggtgtccagcccgattctgccctcaataagcccctggacctcagggagccctacaagagccatgcaaaggaaaaggacctcacgtaccaggatggctgcagcccacgaaggctcagggaagtcttggattttgagtcagggtttgaaggagtctgactctgtccatcagacatcaagaggggcactcgaggggcacctagatgcctcagtggttgagcatctgcctttggctcagggcgtgaccccggggtcctgggatcaagtcccgcatcgggctcccttcagggagcccgcttctccctctgcctgtgtctctgccaatccctgtgtctcttatgaataaataagtaaaatcttaaaaaaaaaaaaaaaaaaaaaaaggaggggcacttgaggaggagcacttgaccaggaaaatccctaaggtaggtttggaaagcagggcccaagttcagagaacatgcagggttgaggcaggctggactccactggagagacgaccagaaaggccacgggggccatggcaatcccatggtgacctgacccctaggaggtaaaactcaatgctccttctgcaggagaggccacgggggagaggagtggggtcagcccacctggtccaatgtcctccttccacccaaggtcacacagtgagttggcagcagagccagacccagaatgcagattcctgagctatgggaagcctcagtggtaaaaggacccacagctctcccctgagtggggagccagtgatcaccccagcatccccagacctcatagtgaggttcaggagagccccaggaccatcccactggggacactcaggtacactcaccagtcatccctctgccaaaagccacagacctgcccagctccccagcttgcatggctcagaccaaatcctctcacctgaaacccccttggatgctctgtcagcgggagatgaggaccaacattatggagcccggctgtgcacccacccaccccaccgccagctcctctctacattattccacatccttggcctgaaaggtacatttgagtctgcccatttcacagatgagatgagcaaggtccagagaggtggagtgacctggggccaagctctgggctacctaccatgtggctacctgcaagggcagggagtgctctgggcttcgctacaaccaggcattcagccgccatccacagtctacacgctagacgctaccctagcactctccatgcatttgtgcagtcttcacggcgccctatgaggtgggtttctggcatttcacggacaaggaaactgaggcacagagaggtgccccccaggtagtaaatggcagagcaggggtttgaaaccaggccctggagccaataccttaaccactacatgctactgcctcttggggctccctgtctggctggccctacctggctcctgtctccagctctccttcctcagattgggggagagtggaaagggacagcgtggggggggggggggcatgggtaggaagaggcccacaggataagatcctccctcagggtccccccttatggctcctcccccatcacctgtgtggctcccggaaaattgtgcagggaccacttgcctattgtacaggtgacaaaattgaggtcctgagaggcccagtgattgcccaagggcatcaaaatcctggccgcccccctttcacaaaaccctgtgcagcaataaggagcaggatgtgggttttggaatccctgtagtccccctctccctgcccccagggctcagtacttcctcttgggttcccaggtcaataaccaggaaaagccatgccccagggcctttgtacttgctattccctctacctaaacactccacctccagatatccatagggcaaccccccttactctaccaagcctatgcacaaatgtccccttttcagtaaagccacccccaaccatcccattgaaattggccccccactccttcacctctctagttacttccctgctttgttctccattaagtatttatatgctttacctatccactgcctgccttccccctcaaacgtggaagcccagcaaggcaaggccttcctccgttttgtctcctgccttataaggttccttaaagcagtagtcctccacctagggtgcacgtgggtttcaccggggaacctgagtcccatctcagaccaattaatctgaattcctggggtggggctcaggtactaggattttttcaaattccccaggtgatttcatcgtgcagccagatggagactgctgctggcagggctgggcacaggagatgctcagtatggagttagtaaacgaaagagtgagtgaatgaatgaatgagtgagtaaatgagtcagtggagaattaattgatttttataggtggacaagccgaggtccagtcaggagagagagccagatgctggcagtagtgaacttgagcctcccaggctctgtcccacctcaaccgcaaagtcacaccccttgcccacccaggggccgtcagctcccacctggactccaggagcccaccaggcttccctcaagggcatttctgggaagtccccccagaggccccactccctccttctactttcacaataacagacttgtttgccagtccagtcgccagggctgaatcccggcttccactcccaaacctcctgcattccgagcggctctgcaggcacagggggcacctgggaagtagcaggcttgccagggctgcagggtgggtggggtgccccctggggaagccaggtggaaggggaatgccgggcccactcagagcacctggtctggtggccaacccagccccctcgcaggtatccaaacacaggtcaggcctccacgtctcatcagccccctggaggctgaggaatcaaatggctctagtaaattcccctggtggttgcaatgagcagccaggcttgagaaccactgaagccacacaacctctaccccggcagccctacccacccatcctcccgctacccctggatccccagcatctgactgtattgcgggggctacccctccaccatggacaacatccagctggtttggacagagctcagagggcatggagagaactagcaaaggagtagtcaggggggctctgagcctgggcctgcagctgcttcctggggccacgtgtccccccacccccctcggtgcaggcttcagcctgacccttatgtcttgaggccccccttcccggactctcaccacagacggacagctgatgattgtgggaaagaggggcacagtcaagcaaggcctatgtgctacccctgatagtcaccctcagcaagacccccttcccacacctcctccacacattccccacccctcatgcggcctagcacttcacaaacactaacctctggcaaaactattctggtgacaccagtgtcccctgagcacctcctcagggctttgcacacattatcacctctgccaggcaaataccatcatgcctgtgagcaaacagactcagaaaggccacacagagtatcaggccaggtctcaaacccaagtctttctgatggccaagagataggagagcagagtggcgagctgggtagcttctgggccaaacagcctgcatttgtattccagctccaccacacatgctgtgtgaccttgggcaaattgctcagcttctctgtgcctcagttctctatttgtacaaagggaataacaattacacaccagggcttgctgtgaagattaagaaaaaccctggcacaggatgtgtgttttgttgtaaatgtgggatttttccacctcagacacctctcctggagggtccctcactcaccctcaaatatttattgaggaagctttgttagaacaaatctctaacaacagcctcaaatggtacaggattagatatgcactaacagggaacagagatttgggtgaaaggaattccataagtcagggaggaaccggaggtgttttggggttggagatacatccaggttggtcctgggatgaccaaagtggtgggcactggtgggcactggtttaacccaatggtaagatgggcctggctacaatcatgcccacagccaagagctgatacagaactctgtagaccatggcgaccctgctgatagcacagagtctggggggacatggggacagcagatgcctcactctccatgagttcattcagccaagattcctgagagcctatgggcctggcaccaactgggggtcctgcaggtgctgctgagaggctggcggggtcagctgatgtcctctgactcatctcacttcccaggtgggagctcaagtgtagccctacacccggctgcctcagttggtagaatgtgtgactctcgatctcagggttgtgagttccagccccatgttgagattacttaaaaatagagattactttaaaaaaaaaaaaaaaaaagagtagccctagattatacataaatgtgggcctggtatatacccacaaaactttatttatgggcaccaaaatttgaatcccacatgcgtttcctgtgtcgtgacattattcttttgatttttttccttcaaccacttaaaagaccaagactattcttagctcatgggtcatacaaaaacaggtagcaggccagatttggctcttgggctaacccctggtctacaggggaaaggcaacagccaagaggaaaacaaggaaatgtgcacatgagtacaaaccatgatgagtaccataaagggaaagacggggaaacaagaccgaataattgaggggtagggtggcttctctgaagggagtccatttaagcttcaggttgaatgagaagtacctatccccacagagtgaagggagaacattccatatacaggggacagcaaatgccaaggccctatggtggggaaaacagtgtcatcaaggaccataaggaaaacttatgagtttaaggagtgcacccaggagagacaaaagatgtggtcggagtgcctggtagcacagagcctctcagacaggcaggagtttggaaatttgcattttaatctaaaagcaatgacaggtttaataggagtgagatctggcttttagaaagctcactatggccactgagcaaaggtttggctgtggagaggcccatttggaaggagagagaagagaaagtttctgcagtggtctggggagaggccccaggggtgggaagggtgaggggtgtcatgtctagggcacattctaagaggaaagcctgtagggtttgctgacagtagaaaaaggatgtacaaaactgtcaccagattttttggcctggtgctggaaggatgaagctgtcttcaagggagtgggcaagctgtgggagggtggatagactttcttgaaagttcctcctcgttgtgcagtgaaaacactttgaagacacaaagccacatcctcaatagaatatcttgtgttatttaagccataaagtttcccccagagtcctgggtcaggcactgaggagcagaacaagccaagcaccaggcaggcagctttctccagaagtaagccacaaacctttacagcacttacaaccccatgtgggtccagagtatcacacagccaggagggctggtggggggttgcacagaaggcctaatgtggctcaccagcgcccccggccctgcctttcttaggaagctggggcacctgcccatctccaccctctccccagctcaacagtgtcccctctgccccctcttctcccagcccccttaagccctccctccatttaccccactccttctccccatgctccattgtctgacagtgagacctagctgttatctaaaagtttaggttggctgcttggtctgcaggaagacgagaggcccagcagatggtggggcctctccaggatcagcctcaaaggtcaccgtctgtcactgcccacccgctccagcctcttccacatcaatggagtctctcatgctgatttcaggccccacaagctgtgcagtgacatttcctgcgggctgactgtgtgccaggcaccgtgctaggccttctctggacattaactcttaattatctcacctggtctatgaggatatgttctcataggataggcctatgttctcatccccattttacaaatgaggaatcagaggggcacctgggtggctcagtggttgagtatctgccttcagttcagggcgtgatcggatcaagtcccacatcgggctccccacagggagcctacttctccctctgcctatgtctctgcctctctctctgtgtgtctctcatgaataaataaataaataaaattgtttaaaaaaaatgaggaagcagaggcacaaacaggcaaaataattagccatggtgacaaagactctctggctccagcatccaaattcttcaacaccaggctggataaccccacacacaccaccctcttcaagcctcagcttttctgtctgctgcaaatgaatgagggactcaatggaacgatttctggatccttctagcctttacaagtctggaatttaaaaactgctttcttccaaggcacctgatatattctttctccccccaacagtggctgctctcagggaaagatcttcttggcccattcacactatggtataaatgacctacacggtgaatggaggtgaggggactctggtggaaagattcaaacccaggcctaactcgttccagaacctgggctgtcccaacatagcattgcgctagccacatccttgggctttaggagctcttccaaaaggtactctttacacccatcaatattccctgttcccaaagagagagccaaaatgaggatgaaggaagaggatgggaacaggaagtaagggatataagctatcaagtcagacccacgacttctgagagtcagggcttctggtccccatgaaagcctgggtcccacttccaacccagtttatttggacaggcattctggaaggagtcaggcctgggagctgaggacctaacttctggccctgcctagaaggacttagattctacatctgtacgatggggagttggccccttccagctctactagttttgagttttgctcataccctgaccccaaaggcaccccattagctttctccaggtaggaaatcacctctagtgcccccaagcccagagctcctctctgagctgtgcacaagaaactcacctcttagaagaaggggagctataatcacagcctctggtagaagttcccagcaggccccacttattggccttggcagagcagggctggggctgcagtgatgccctttgaaactgacacctgacacagcagctctcctggcctgggcgcccctccctcatgctccccaggcagtggcctctgctcctgaccgcccccaacaaagttcaacctttttgcctctgtaaaaggcttttaagtttctcacccagcctctcatttctcagtttaattattgaggagccctcttgtcgccaggctggaacattaacactgttaaaaaggaacccaaggaatgcagaccacagatgactgcctccctctggctctctccccatctcccctgccctgaatctcctttccaacatgtccctcctgcccccattccttctctcctccccaggcccccacctcccaatcccatctcactttctgtgcagcagggaggctcctgaccccctgcctcaacccattcatctctcgggcaatctgagaaggcacagataaaactgaggcctcagccatgttcataggtaaccagatgggcagaaaaaaaggagtacctgtgagcccctaggctggtgaggcctggctccaggcaccctcaccctaccagagaccttgtgccaactagagagagattagcatggaagtcacagtgcactcccagtggagtcattgatgcctcactccaaaatatccatgtttccaagaactcacagataccattcttgtaccctttaccctgtgtcaagtgacacctctccactcctttagcctctccatctctccataaagtgggtactggctcatctctgggagatggcagggaggcactcactgaggtcatggacacaagggtcccatcacctttggttcaggatgtgatcccagagtctcgggatccagtctcacattgggctccctgcacggagcctgcttctccctctatgtctctgcctctctctgtgtgtgtgtgtgtctctcatgaaaaaataaataaaatctttaaagaaaaaaaaaaaaacaagggtcccatcagactgtcttctaaaacacccacagtccccaaaagtgtttttttttttttaagattatatttattcatgagaaacagagagagagaggcagagatacgggcagagggggaagcaggctccatgcggggagcctgatgtgggactcgatcctgggactccgggatcacaccccgatccgaaggcagacagacactcaaccacctgagccacccaggtgcccccaaaagtgtttaataaaaagctccaataaggaaactgcaacagccccatgtatatagtctgggcctcttctccaaggccgaggacctaggccccacccagacagattgacaaggagtctggggcttgtcctttctgctgatggccccaggtggccttccctctcaggcctggggcaggcaggctgaagcaatgactcagctaacctaagccattgccaggacctggcctgggcagctgagccctgctttctcctcccctctgggtctccactcctcagtgcgggtgggagaagtggaccaggctacccattcccaaaccatctgtaaggaatgatctctggcagcacagccccctgggggctgtttggattgtctactgcaagggcaaagtttccttcaagttttctgttcagcttaatctggcattcttcataattcatccatttgcttaaaaattaagatagtgtttccatttggattataagtaaaaccaacaccccaggaagaaggcccataggtaaggagcacaaggcacatgaccccacaaagttctaactcccaccccacgctgtaacaggacaactctagcttcatttctttcccactcccaccccatgcccaacttagtggacttctacaccattcacctccacttcaacccaggcccctaaaaatgctcccaaagtactgatgcactatgggactggacaaatgggctcttgaaaaggtctaggtgagagagtcacagcctcaccacttcccactctgcatgggcccagacagcctctctcagcccactgggtctaactttggagactgaggagggaaggggccacctccagaggctgggaacctgacaccaggatgaaggagggacccagtggcttcctctgtgctttccttcctcctcctcccacatattttccctccctccttccccccccacaccccgcaccccttacacaacacacacacacacacacaagcacacaagcacacacaaacacacagcaaagaaggcaggctccaaagaagagcggctcataattattggtaaaatgcttgtaatgtttttctctctacccggtagctttcagttgttttagcagcttagcgaagcacttggctccaattgaattgcaaatcagcagctcttgccccaggaagagaggaagggaggtagcaaggagggggcagggaaggattccagacgaaagggagaaaggtgtgcaaggaagaagggcaggaggaaggaaatgagcaaatgagcaagggaagcttggttctgggcccagagcaacagctacagagaccgcctgctccttcgaggccctttccctgtcctcatccaccatccaccttctgctgtagcccactgccccatccaaaatatcaagacacattttataaccataatcttggggtgaagtgtgagggccacactgggctttctcaactactacaagaaaagcatatctttctagggaattacaatttatttgaaaacaatgtcaaaaacaaaagtcttgctttatctctttggcagtctccaacattcatatttccattttatctatttctttgactctgtttctctttctgactacatgtatttctacatatccatctgtctgtctttttacacatctgtccacctatctccttccttctgtttcaccagcacttcattctcccctcttggttcagaattccccacagaggagcggagttgatcagggaactctgggcggccgtgctgtttcagtaccatggtcagcaccccggagccgctcctccctgacacctacactcctcggatcctcagctctcaccacaggactgcccccaaattctcagatactgttgtgggggatggtacagtcctcagagtccaggagggaagaggagaaagaaactagccaggcctggcaccctgggttgttggcggaagaccacgtctggggccaactggccagacactaaccttgaagaggcgaaggatgttggccaccatgatggagacagagctccctgaagcaccgatgacaccgaccacacgttccggtttggtgatgatgggggggccgccactgccacagcggacctctgtgccatccttctcgatgagcgcctgcacaaaggtcagggactgctcgagggcatgggtgtccctcgagcaggtgtccagaatgcgggcgcccagcgtgatgttgggcagcaggtccgggtcattgttgatgcgatccagggcaaagagcatggcctccagccgatggatgcccttctccttcttaagttctccacaggccttgccctctgaaccccgaccgtgcactgggaacaggccgcccagtgtgatgtccccatctatgcgaatggaattcatgtgggggtggcccttgggcttccccagggaggaaggcacccaggggccataaaggctaaggagcaggcaaagaggcagccgggcccaccaccagccccagcctgtcttcccaggcatctcggaaatccctagagacccatgaagggcaggccccactcctagccttggcaggcccctggccccacagcctgggtgagcatgggcagggcagcccccacaagtctctccagggctgcttcagcagcagggtggctgagggcagccaatggggtcacccatgctggtgctcctcgccactcaggcagtgctcagttgctgacatgggccattcccacaggcagcagggagtggccagggagcagcaaagctctagtcttggtcctcacgttctgcgggcctgttcttgacggatgaatgtgaaaagagagtgctcctagcttcacgtatcttggcatcaaggagaaaacagcttcaatgctctcctcctaccaaccttagaagggagagagagggagagggagggggagagggagagggatggagagagggagagggagggggagagagagagagagagagagaatcaaacagaagcccaaagaagacattagctattctgatctctcatgaggagcctgagagaaggagatgctggaggttatcgccacaggctccacaaatctgaacttggttttctcccagctgctgctcgactttggttcaagtgggagagcctgaggcagaaattaggtcatgtttgaagatttcttaggcctagacccactgccatcagaaaccaggggatcagagtgcacactccccaggaacagcctgaactgacttgagaggaagaagggtcttcctcaacactcacccacatgagggaacagcaagaaatcaggtccacaggatccaaccccattttagagatgagggaactgaggcccagagcagaagagcattttgtccaagtcacacaggtagtgagaagcacaataccacgcggaccccagcttcccagctctggagccaaagacacttaggttccttggggactgaggaataaggaagccagcaaggccccctgcagaagaaaccaggctgggagctgctcactctgaagaccagggagaagctggggctgtcccagctcagaatcctcatcccaaatccaatcgggcaatgcaaatttcacatttctacctcagccacacccctggcagacggtaaccccaggggctccaagctcaaggaggtaggcctccttttcatttgcttggcctccctcccccaccatctttctcatggtctttagctctcaatttctccactgctctttctctctcccccacttcctccctctgagagggggggctcaggttatggcctgaactactgcacattattatgatcattgtcattattattgttgttgtgattaaatatttatctgcaagggtagaggagagaacaccagctcttcctcattctcactgctaatttgggctaatttcccctggggttccttcccttgccccagcctcccactcgctcaaaaccagcaacctccctcccctcaacttagaaggccacagggagaagcactggaagctgagtcagggattggttggggggctgacacccaggctcccattccaatgggtttgtcaaatgaagaccagcaagccactcacccattctgtgcctcagtttccctagccatttagaagaagggcttgtgtttggattaggaggttttcctagagatgcagtccctgcatccaggccaagcaagcctctcagagccacctgtcccctgcttggacttcccccacacagaggccccaactgctccagttctgggaaaggagaggaagaagagagtacagcctcaattcctgagcttccctgcctagcgccttctgaaccctcacctcacacatctgacccctcatcaaaatgtnacacacttgtacatacatatatcacatacacataaacacattacacacatgccagacatgaacacagcacataccaatacacaccacatgccatatgcacacacaccctacatacatactacacaccacagacaccacacacacatacaccacagacacaaacataccacacaccagacacacacacacacaatggggagaagcagaggccacatggtggaaggaggcctcaatgaggagaaaagcaaattcttgcaacattagaatcaagagcccaaggccccaggccctgccccctaactgctcacaggcttccctccaccccgacggccctgcccccacccacagcagtcccgctccatccctggtcttccccatccctggtctgctgggtctgccttttctgaacatctccaaagagctgggcaaaccaccgcctcttttagcctcccctccttcttttgatcctgtaacaggaacaagggaaaagtaaaaatactctgagtaaaaggcgccaccaggagcagaggctgggggtggggcagcagggggagccaaggccatccttccatacccttccgtaccccaccgggcagcctccaccttagcaaagaggggccagatggggggaggttgagtcctcaggccaccccctcaattctaaaacagccagggaagctcacacttcagacgtttgggggctggaggtggggggtagggggtggggagtggggggcctcttattctacccttccctctccttccccacctctctcctcaacctgtctattcccttcccttccaccccctgtcagatctttggctccagataggcagggagggacaaggagcaaaggaaagagcacacggtcatctccacacacaacagcatctttcagaacatcctccagagaggggatgtaaggagagccaaggagggagggtgcagtctgccctcctccccctccagcccaggcaccctacaatctgagggcctctctgatatctgcaggcctgcagggagaaactccccaacctgccttagtgatccttccaagtcccatgcttccgcacgtctaacctaaatccttccctccacaaccagggcctgagccaggaagaaccacaaaccatggaacgacaagcggctccaaagagagctactgcaacgtttactaaactcactcagctttttattctcccaaagctagggaaagagaattctccccaaacaccaaagtaagggacagagtcagagggaatgaccctgcacttggcacccagagctgctcaagcaggctttcagcccctgcaaggccactcaagctctgggctcttccccctgccctgccccagcaccccctctcaacctctgccttccttgagccaggcctcctccctcccctcagcttttccacatttcctccccaacttcagtcctctccattcacctctgtctctgtggcctggcccagcccaggtgctcagcaaagctgggcgtggcgtctgttttgaatctctgagctgtttagacacctcatcacccacaactcacacttccacgggaggggctctgctccccagcaggaaacatgagggagaaccagggcccttccccttcttcccccaccaccccaagcccacaggtgcccacgcagacctgagacgctggactgcaggccacctctgaggccccctccctcctgccccactgggggccccgcactggtccagcagaggtgcgctatgctggacagtctcctcccaaatggacagagcctagacccaaggaacaagcaagaagacgctgcaccccacagcaacgaggcctatagtttgatccccacccttgtgatccctggtccatggggaaaggggatggctaattagctccctcaacctcaacagcccaaccctctccccacagggaccacagcttgaggagaccgtgtcatactcctcttgctatctctgcatcccagcctggcacattgcctggcatcccccaccagagcttgtggaagggaacgaatgatgtgatgcgagtgaagaattctgggctcttcccaccctctctcccaggtcatcagtgtcaatattaatagaaacagcagccctgctcccagacactccccagggccgtgccaggccatgtttgaagagcaaggaggagggcacagtgggggtccaggctccatggatctcattcttttcccatccccaagaagctccagcccaccagcctgtatcaggaaccctcccaagtacagaaatccccagatcttgcttcataggccatcccctccctgttacaccaaaagagcctgattccaaagtgactggttcgctgggcatgtggtgggcattgcagaaacatgcaaggaaagaagaaatgatagaggacaggagggatgagaaagtaattcctcagctcaatgcccatagaaactagagaaaacttcaaatccgccattgtggttcctccaatctaggattccctccagcctcctccctgtgactttgacccttcaggtagcaactgagacccttcctcctccaggaagcctgccctgatgatcctagctctatttcctccttcttgcacattcacatctccctctctctttctctctctctctctctctctctctctctgtgtgtgtgtgtgtgtgtgtgtgttatttggcaatgatgagcctggaagattttaagggcctgtgtggaccacactcatctctgcatctcctgtgcctagcccaaggctcagaaactctcaataagcaacaacacacggtctttgcccggagccagcaggcagccaaggtgatgcccagggcagggtctgaagcagcattctgcgtctgcagagtaaaactctgacctggcaccaaatcctcacacgtccctggtgtggtcaggcatagaatacatcctttctgccataaccattcagttattgaccgtgtcgatcaaatgtgtgctggctctgctctgggcactggaaatgtgctaggagtaacagacacagacagcagcacccacctcttggggccaacctggggggtggcccaggagatgcaataaacatacttacataaagatatgtggcacttcagggagtccagaggttatgaagaaactaaggcaggtaaggagagaggtcaagaccctggggtctgttcagaaaaagatagtcaaggcaggcttctctgaggaggtggcataggagaaagcaactaaaaacagtagaggtgtgagccacaaaagtgtcccaggtagagagaagcaagggcaaagtccctgagttcatgtttagcattgattgttcaaggactagcaaggaagccggagtacccggagggcagtgggaacaacgggaggggggagaggaggtcagagagggcatgggtacaagatcagacaagacctgtgctgatggagaaatgggggcccactggagggctctgagcgcagtgacaggcaaggattcatggcaagagaaacctgagactcaaagagatgccacctgctaaggccacagcagctctggtcagctgaaggcaaagcaagcccatctcatcagcccaggaagggcccgacactgaccttccccctcgcccggagggggagcgcaaatctccatttgccagcccccacttccatgtagacttccaggcctctccttcctaccccaacttgtcctgcctccacctaccaccactgccaacccgcccccctcccagtcttctggcacaatccaagtgggcatgtgtctttgtttgcagctggtgctactgtgagcttcccgactaatactgtttcttcctctctcctccttcttcctgtccaaacacctccttaactcagagctccccctactccagcactgccccagagggagagggcccacgggcttcacaagtcaaagcccagactctaccatcttacacagtcataagcacaaccagttgtgggtgaccctcccatccccaggccacacaggagccaggcacagggaagggccagtgctacctgtgaagtaaatggctcaccagaaagttaagatcaagtccccaatctttattcctaaagatcaaaaatcacccagtgattttagaaacaataaaggtgtaagccacagcaatgaccgtgttttcactagaagtcacaggcccaaccagaaaaccggtccagaggccagtttctatcaccctgaagagcagagaggtgggaaggctgaggataggggacagggcaggacccaacctcgtggtccagcctgggactagcagccagctggctctcctgggacccccctgcattacagccaatgggcagccagtgctttctccagaatggggaggcttaaccagatactacagctagctagtcagcgtggctcagcctgaaatggcatgggctggcattatgggctggcatttcccaattaccacagataatatctcccttaattgaatggggtccagataatgtcattatgcactgcattccccaatttatttaatatacatgtgtacacatatatttatgcctcactgctgccaacgacattgctaaaggtgaggttgataataaaacatttcgacgggagtcatcagctttaatttaaggggtgatttttactatccttgtggtgctcatttttccaaagagccaagagaaacaacggacaggctggaagaggctggctcaggcctgcgggctaggaagtggggtgggcagggctgtggggtaagcttgtcttttccaagcaagttctgctgctactcctccttcttaggagtgagttcaggcagggaaagggggggggacaggggggagcagaggcagaagcaccacccccccccccagcttgactgcaggactggcagggaggaggaagcttgtctggaatgcagagctaagaggctggggtagcactgagaagcagcagggtgacatactgggagaaaggcagggcaagaagacaagggaggccagagccaggccagagccagtccacagccaggaaagaagcagagttcccaggagccaggaaaagacagtctgcactctgcaagggtcaaagacagtgaaatctctaaactaatttttgatagtcccctgctaactggggcagagttgacacgaaaacaagccctccttgctctttccaggagtcagcaccaggctaggtgggagcaacggaaagccagtgtccttggccgcaggccagctacccaccaaggcaagcccctgagtctcctgcctcgggtcagcccagctagctggccactcctctgccagccccagcaagcaggaccagagcccagatgccggcttccccctatgccttctccgggtagcaaaggcagcttccactctgcagaagtgagataacctcccagccagcagctagcgggcccagctgcccaggctgccagtggggcctgcccactgcaaagttaggttctcagccggccaagcagaggaggacaacggggtgggcagatgtcttggggtgggtggtaattaggggctgcgagctccagacttgtctagggtagaggatgtgtctgttggctgtaattataaagctcagaaacccgtgggtcccctgatcccatcttttcctgccagctacccccctgcagcagggtgggttgaggtgtggcccagcatcctggaagctggaccaggggaccccccatagagctttttgctccctccccttcctggtagcaggtagcatgctagctgctcacttactggctggctcgctcactgatgctctcacctacctcgggctgcctgtctgccactgtgccaggcgctcctcttggggacgtcacgcctccaacagaatgaagacgcccagacgcaggctgggggaggagggatgagggaggaagacaggtgcggcctacactaggccacaaaggccaagaaaacagctcaactcctgacatgctcccgccccccccttccccctctgccagctcaggactccttctctgtgccctgcagcctgccctaccaccatcccatatatctctcatttaccaccagtagagcatccttttgggttgagcattgccatctcctctctgggcctcttgcaaatgcaaacatcccagagaaaggtagcccttgcactgactgctgcctggcgggaggaggcgggtaataactttttggtatttttgtctctgagaggttgaaggcattgacaggtgagggaaagtttatggctaacagacagaggttggaggaaggggaagacagtggtcatccaatacctaagtgggcaggcatgctcatccaaggctaagcagagtctcaagggtaccaaccccaaaggcccccaaccccatgtcagggataggactctgagtaagggccaaagaggccctccagtggtcttctgtggggcccagggaaagggacagagctctgagccccccctccactgcagacgtcctcttcaggggccctcaccactagctcccagagcctgcccaggagccgggaccacacccaagagcccccagacacacctgtgggaactctctgccacctcaggaaaggtcaccccgaaaggctccctagggtcctcacctcttgactgaagtgctcccaccacccaggcactggcttctgaagagttcaaccagcagacgcagaaccccaggcccacatcccatgtggatctcagaggggaaagtggggcagacccagcgcgcaccctgggggagtagggagatggaatttagaacattctttatttccaccatgagctggccccagggacgtgaggctgagtagcaggctgtgggaagggggtgcccagcgtggagactctcagagcactggccccgccgcctaccctgaggccccacagtggcccagaatggaggatgatgggcgcacacgcgcgcacacacacacacacacacacacacaccctcccccatcaccgagagctttccgacagacgacagagggtcagacagactaaccacggctcccactgacacgtggattcgggcaccccactaggcaagcccagctcagtccgcaaagcggctctcccgcacccaggggcaggcacggtgccgagacagggtaaggaagcgcggagcctcctccgaaacggactgaactctaaggagggggtgtcactcgtggcctgggggcagggggcgctcgtacgcggggcctcaggactccccgccgccgccactgccgccccatttctgcacaaacagcttcagaccgccccggtgcgggggcgcctctctcaggccgggcctccgcctcgcagccccgcccccgcgcggggagggggcgccgccagttcccgggcgccggggaagcccgaccccggaggggaccccccagcacacacacgcgcgcgcacgcacggcctggccacccgcccggcggccccacagagcctcgggttcaccggggtcccggagagggtcggtgcagagtatcggaggagcccctgaccctgaagtcccggggccgcgcggagcccccaggccctggggcgcagtcccaagccgcagcggccgcgagccagcgggtccccggctcggccagtggcgaaggtgccgctggggcgaccagggtagcgggacgcggtgcaagggaaaggagccgaggcgcgcgaggctggcgctgcccgccctgccgccgggggaccgcggggaaggggtgcagatgacgccccgcgcccccgcctgccctgcccctccgcggagggggcgcgctaatgcccccgcccccacctgagagctgccacgacccccatttggcagaacctgacataagccccactgcacagagacactttcccccaggcccggaaaataaataaataaataaataaataaataaataagccgctgccccgtccctccctcgcgggcgttcggggagcctgccctagccccgaagggagaccctccagcccgggtcccgcgccctccggccccgagggctccggtccgccggccctcctccgggcagcccgagcgcgggagctcagaggccacctccgcgaaccccgaggtccccgccgcagcccacgccccagaggccggagggcaccgtcccctccgccggttccccgcgggccacaactcaccgcgcgccggcgaggtctgagccgcggcgaggggtcggttgcgctcccgcctgccccgggggcgccgggaggcggcggcggccgcgggctgctcgcgctgcccagagcccgggccgcggcggacggcgctgacgctgcggaccgagccgggcgccgagccgcccggagtcccggacgcagcggggatgggccggcggccgcccggccggagccgcctccccgcgcgcggcgttctgctgctgctccggcaagagcaagggagcggcggccagccctgccccggccccgcggagcccggcgtccaagccgaagggagcgggcgaggcggctccgggcagcggggtccggccgggggctccgggcgggggagtgcagcgcgagccgacctgcgagcgcagccggccgagatgcgggcgcccggcggcgcggcggcagcggcagcggcagcggcagcggcggccgcggcggcagcagcaaggaaaaatgagagcgagcgagagagcgcgccggagagcgagtgagagacggggagagcgcggaagacgcgcagacgggaggctgcgggaggggcgggggcgcccggagcaccagggggcgaggggaccgccgcggctcagcccccgcgcccgccgccgccgccgccgccgccgccgccgccgccctcgaggaggcgcgagccgggcccggcaagtttgcgctgcgagtgcggaccgagcgcgcggcgcctccgccggcctcttaaagagcgagcacctgggcgcccacccccgaccccgcacccgcacccgcacctccgccgccggaaggccgggcgggccgagcgccactccgcctcgccacacccgccccgcagtttccccctcccgccacgccccagcggcgccctcccctggaagcccccttccttgccccgcccccgtgggtcagcccagcggcccgaggacgcgtgggggggaccctcctgactccaacggtcgagggtcagggaacacagcctccgacacacacccgcagaagtacagcaaagcacagcgatgcaaaggggttgcgctcctccccacccctgtgcgtcacgagaactcccacccgcagggcctcttctcacacatccgcatgcacgtggcgtgtgcccccatgtggcatgttcatttgcacgccccaccgctcctggttggagcataccacgggcggggggggggggggggaaaaaaattgggcccccggggggaatttcccccggcctttatctccacccggtggggggggggttttcttttggggcccccctcctccccagaaccccactaggccaggggaacctccaagccctggtccacagtcagccggtctcccatcaaccttggtttgccaagtgtaacaggtggcctggctgccaggctaacacaagccagggaaagaatccctgttggggagaagctggagccccagctctcttccttccctggggggtgctgtgaaaaatcccaggagagggcaggccttagagccaggcagaggaagaagagagggagggagccatgcagccctcttaggattgcaagagcatctcgtcccagactgcagaagtggcttcaattagagctgtgacgtgtgactgtccttgtcccggggagggtgctcagcacagtgccagggagctggggggagaatggctggcaatggcctccctccccctcggtccctcagtcctcctggctgatctgcagggtgccaccctgggcttaaatgtgcctctgcccatggggtggggggcctcagcccccccttacagcccctcccctaattgccatagatagcacccttataggtcaagggaatgtctggggagtctggggacagcaggaatgaccctcccccctactcatctgatctttctccctccatgcctcatatccaccacccgtgccccttcccagagacccactcgggcacccccacctggtccagaattgcagactatgccaggctgggaccgcaactggtttaccatggttcatccggtgcttggcactatgcctgacccatagtgtgaactcaatgaatgtttggtgaaagaagaaatgttggcaaagcatgaactctctttgctgacacattaatggccccaaatacatgtctagtttatccagtcagaccaaagtctctgatggaaggacctagagcatgaattcattcataccttttgaaatgcaatcaacactggaggagatcctattccattcccagtcctgggaatccacgaatgactgaacactatcctgcccttgaggagcgcaccccatggccatgcacacctcagcctggagcattttacagggatgtaagctaaggccacgaaagctcctgccatccagtggctctacgtagcctcatgtgcacagctctgggcttgcaggacactcctgtcactcctgaagaggcctgctccctgggaacagcctgcctgggtccccctgctcagggtccctcagtttccctaaccggtatgtagaacaaggaccacgatgccgacctcagagcagctgctggtgggcaataagccacccgttcagggaatgctgggaggctccaattcaacttgccttgggcttggcaagtgactcgtcctatcttgaggctgcatctgactaaaggggggggtccttcatctaattcatggaaagttaccctaagagctagcggtacctgggtcctactggccaggccgtcgtgagaaaggaatgagataatgtgtgcagagcgcccagtcctgtgttcaggtgccagcaagtgggagccacatttttaacacggtatcgtccccaatatccttgtattgaattaattgataaatcagttcattaatcaataaagctgaaaatacatgggccatggtttatggagaaggcaaactaacacagcctttcttgccatcccctgccctgggtgttgccttcactgaccataattatctcgcccctgccccccaccagctgtgtcgcagaaggctgggcaggctctatttttcaggggttaaaaaaagaaacgctgttggctggcagatagctgagagtgtgcacttgtccagtttgaagatgcccagcctgaagcctcgctctgggcagccgtcccgggccactccggggcctccctcccctccacccccccagagcactcagccccccactctcaccggtgagccccagcttggtctagctgggccaccctccttctcctacctgctggctttggctgacctgacttgtcatggagacagacatacatacacacatagagacacattcagatatacagacacacacatatatatacaaacagccacacacccacggagaccctcagacccagacccacatggaaacacacatatatacagacaggcacacaccctcagagaccctcagacacacacacacaggtacacacacatatatacagatattcaaataggcgcacacctgcggagaccctcagacacacacacacacacacatacacacacacacacacacacacacggatacacacatacacctcaaggaacttcagttggtgtccctgacctgggcatgatgtggaaacaagggagatacagtgccacctctataggggaagagtgatcagaagtgacctcaaggggtcagggaacaagggtcctggtgcctagggccaggtgggacacaaaggcctgaattcccagatgccccattcagcaagctgtaccctgactgttaggggctgaggtggggggagagggcccaggactggaagcaagaggctaggtcctctgtgtaagactgtgtgacctgggggaggttgcccagcctctctgagcattggtttccttaccagtgagatgaggggccaggctggtgtttctctaagcatgctgggattcagggttgcatctcactcggaaatctttaaaaaaggccgacctgcttgacatgagggggggcaggggggcggtgttgggggagtgagcatgctggttgttctaatccaccaatcccatgggcacaggcttccccagagaaaaggagacaccatctcagcattgggggtaggggcttggtggaggaggaaaaagagacaggtagtcctagagaaaataataatactcctgcgcttcatgtcgttgtgacctggaaattcttcccgaagtctgacctaactcccttatgctgcagcagagacttcctttgggctctgattctgacctccctgttatggggaaacaacttccctgccccttcccacccactgtgttggcaactgtatccaaattactcctctgacttcctcatttcaaaggatgccaaataggaaagggtgattgattgcctttgaaaatcgtgaagtttagaatttgttgaaataaatcagagtgaacttgaaagtggccagggccagaggagagcctggcaggcctagaacacctaataaatggttccttgtccagttgacctgaccaccgtctcaacctccatgtctgatgggcttcaattttggtttcccctaaaccaggccattagatgaaaatgcctctgatggaggagttcctttaaacaataactgtcccccagcaggacatttccagggtgaagagctaactgctagagaaggcagtggttccaggctctctgggaggggcctaaattactctgctggcacttggctgagagcaggtgtcagaggcaggaccctggggttaagaatcctgaggccaatcagtcctcttctgcctcctggggtcacaccagcccctctcctttgccccacggagatactgagtctcaggggcatgggcatggggactctgaaattcccccagccaggacaaggtgtgagcgaccccctcctgacactgccgagggttagcagaagagggacctgaggatctactcttcccttaggccagtgtgggtccaacctccaggacattccacttcaatgagctctgggactttctcaggagtcgtgaactggctaaagctatgatccccttttcacaattccaaagtccagaatgctctgaaagccacaagttggtccataagtattccacaaactcctctggctgcaaaagctgatgtgagagcgagtcattgccacatctggctcccttggtgggagataactctgcttcaccgcaggcataggagccagcatattcctttggggaatactgctccaaggcctcctggggtattgtataatagataatatttgtgccatattttcttctaaattccaaaaaaatctaactgaggtttctgacaagggtctgctcccctggaatgatccaattgggaccaaggactctccaggttacacagcatggtcacacctaggccctcccacctgccacctgccttgtgaagggagagaggggacccaacagaatagagagcaaaaaagagcaaattctgaatacagctctgctaaacccaagtgcatgggaccagaggcaaaagccagacgagatatgcaaggattcaggggacattcagcagcatcttgctggagagaggttaacagaggctgcaggagcaccccacaagaatgggggtacaggtaagatgctgggggaccctccctgcctgtgtggtgatgaagccagctgggaaggagaggaagttcatctggtgggtgggcaggggaagcatggtgggtggggcggatggagggagagaaatggtctaaggtcaattttagctgcttccctctgcccctcagctctgaggcctgaaaaatgatgcttccccttcccttcctcagcctcactttcccccacctttagggcaaaagagggaggggagaggagaaaggtaaaggaggggaagcatccgtgctgtctcaagctcaagggtggccaggaagggaggtcagggactagtgtcacttagactctgacagaggagctgagagactctggccccatgcacagggcagtggggcgcacggcccaactgggctttggatcctccacagctgagccagtgcagagcatgcagtaggtgcatgttcgcttgttaaacagatgaagggctgaccccccccccccagtccctaggcatcctccttctcctccctagtttccactttcacctcctcctctctccagcaaccctccctctctcttttttttcttaagactcaggattttccagcctctttgccacactgcaatttaaaactacttatcatccctctctctccacatgtccgggggctgtcagctgcaagccaaatgtcattaggatggatgtcacaggccgggatgtcaaaatacaattaacatttaaaaacccctcccgcctgccaggccttgtggccagcctgctccttgggctgagtggcagggctctgggtgccagggggaccagccaggtgacaggcacaggaggggacacagtccagctggccatggtgggagggggacaggcccaagctggaaaaggcatgtgttctctcggctgcaccccactcacagggtctttttccaggtctgctccccaacacatctctccagtcccaatcacacactccatgggcagcccaagggcagatagaccccaggaccgctgctctaatccagtcccatgccactcccctacttggagcttcagtgtccctcctgccaaatgtggatcgtgatgctgctggggctctgtgaggcactgcgattagagccttaggttgtcctccaaatgggccccaggcccttgggaagaggcacaggccacacagactggccgaccgattgacagctgggctagaaattgccagcaagcccctttgtcaatccctgctgccccctcaacacacgccagccttggtcctccttaggaacctcccagacagtgctagaagggagccccagcatttgctccctctgaaggaggacccagacagctaacaggacagaaagctggaaatgacccccaagacctcccactatcagagcctctgatgcatctctctgcattcgtgctgtctccaagattcttgtcctcactgctgaggtctctaactcagccctcgaggcagcgccagggaggcttccactgtcccatgggggggcagtcatagtcagatcacagggctggggtcacaaccccacggcctctcctcaccccacaccctcagttatcctggaaatctaagccacatgcaggatccgattccttgctaaggcagcggcattcctgcaaacaccctttgccctcctccttcgcccattttctcttgcctcttgcacctgcctcacaaagaccaacccatcacacaggactcccccccctccaagaggacaaagcagtgctgggaatgaaaagcccacacccatcagctcctcccttcgtgggctgcattttaatggcatttgattggattggatgcgcttttaattccctcctgggacatcagaaggagggtagaaagaatctttaattcatcaaactgaaatattaatagaacaccaaccagctggagtggggtgtgagaccccccacaattgaagacgaggattgcgcaggagcaaggtgggagatggctaggtgggaaggaggggcctctcagctgggctgggcgcgggaatgggtagaggacccagggctcccagccctcccaaccctcccaccccatgcacgaagtcctacccaaacatcccctcacctgggcctcccctagccctcaccgcctcaggggtctttaccacccctttgggcctgtacacctgagcaactgaggcgcagaaagggggagccaccaggccagtgcttcacgtcagcttcaccacagaattcagcctgacctctggacccaaggcctccctggccccagtccctgggggtcacaggaggagtgggcaccctgaggcattggcttggtcccaccaagcgttccccacctgctgacagagcctaactcacctctccaggggcaaaggcttttcccacacactgcagaggtgggggctgacggcagaccctctcccaagagtagggggagcttcagaggcgcaaaagtagaagcaggggcatgaaagacaccctctgtttctggcaggcgggcatcagggtgtaagctgacaccggctgaccttggggcggctcagattaaggaactctgtggttaaaggccaggctcttcttccgcctgagcctaagacacctgctctcagccccagccacgacactcactgtgtcactgtggggccacaggaggtcacttgacctctccagcctcagtttcctcactaataaagaggggctgacacagctccctttgcaaggttgctctgatgaccggccccagagatagtagagctgctggcaccaggcctcccgctgctcctccctcccctgcagcctccagcccaagtgggaccctgggccctccttctctgtctcacctacatggtggatcaccttctcttctccacccgagacaccaacaaccccccccccccagtcgcccacctccaagccccagcttaaccactacccctgtggagaattcccgagctttcagtctacatcccccatggggaaggatcatctcttgcccctctatttcctgtgcccggtgggtgtacagcctgtgagcaccagggtcctgaatagacaggtgcatggacacacagacaaacggttagatggacaggtggtcctgacctccaccaccaacccctgtcccaaagttcagaattcaggaagccagtgggaaacggacagaacgaaaaccaggagcgcagggctggtggccccgctcctctgccggctcctgcaggagggggtgcgccccagcctcctcgggcagggcccattcagcccccttccaccccagaatttcagggagaccacatctcagggcgctccagatcgggaaggggcgcgaagagcctcctctccggagagcggccccgcgggccttccctcccctctcccaggcccggccgggagccccagtcgccgcgaaggcgccccagtgcggacagcagcgcctcccggtggccgagcgccctcactgcagcgctggcccggccccgggcggctctgcccggacctgggctggaccgaggccccggctgcgcggcgcagagcgctcggcgcctcctccctccgacgccgggtgcgacgccccgattgagaggcctgtttttcacctgaacagattcccggacaaggcagcgggggcggcgaggggtctatttcaaggctgcttcccagctgggccgccgccccctcggattcttgcgcagcccagctcacctgctctgacggcagggagggagggggccccttctgatgccccgccaagtccagggggagccgggcagacccggggcaggaggcggtaggtgaggggatgtcctggattcctaggtgggcagaaggcagtgtaaggggggggcggagtgcgatgaggaggcatgaaaggggagcgaggggggcgtcagccccaggaggttgcatactccagcctcccaaaccagcctcacttctctctctgcccaaagtcaacatttgctgcactcccactatgtgccaggcccgtggctggcagccttactgaccactggagtcacctgggagcttttaaatatatatattttaaaatttttatttatttatgatagtcacagagagagagagagagaggcacagagacacaggcagagggagaagcaggctccctgcaccgggagcccgacaggggagacgatcccgggaccccaggaacgagccctgggccaaaggcgggcgccgaacggccgcgccacccagggagcccacctgggagctgttaaaactctcaatgtgggcagccccggggggacaacgttttagcggtgccttcggccagggcgtgatcctgtaatcccgggatcgagtcccacgtcggggtccctgcgtggagcctgcttctccctctgcctgtgtctgtgcctctctctgtgtgtgtctctgcctctctctgtgtctctcatgaataaataaataaaatctttaaaaaaaataaaactctcaatgtccaggcacatcccagaccaattaaatcagcccctgtgtggtcatctcaggtgatgcacagtccaaacatgtctacggcctcagtgtcaggcatcacctcaggcatcaccgatagcattgacaagctctgtcgggggtagccggttatcttcaccatggtcctgaaaggcacttggagtagtccccatccccgcagagcttaacagagagctggtatggaaccccctgtgtcatgcctgtgccaataaccatgtcctcccaggggccccgaggactgcattctgaggggacagactggagatcagggcaggtgagcactcttggaaaagagctctttccaaatttggaagtgtaaacagcaaagggcccaagggtggagaggtgcatgtgtttcacccatgagggcccatggagctccagggctctgagccacagctctgcttgttagacaaagggagtggttccaggggcactggatgaatcctcaaaatagatgccaagtctactcaacagcgtgggtgaaacccactgtcataatattgagcagaaagaagccagacccaagtatacatactgtgtgattccattcatgctaagtataaaaacagaataaataacctatggtgagagaagtcagagtactggtaatctttgagggggtagtgaccgaaaggggcatgaggggacttctggggacttctaggttctctccttcgtctggatgttaatggcacgggtgtgttcactctgtgaaagtgtgttttacttcagtaaaagtttaaaaaaatacacagaattatgaagctgcccggttcccagaaatgccccctgggcctcaggatcgcttaaaatcaggtccagagctcctccacctctctccccagctcccatctgcctctccctgcaacccagctccatccagggtagccggaaacttggtgtcaaagctaggattctttggttgccagcaataggacaactctggtcaacttaaacaaaaataaaataatggggactgacttgataactcatgtgtaacttgccagtggtcactgccagttctgtaaaagtacccaggctgggtttcaggccgccttaggataacagcagcagcctaaatccagatccctgcacatatccccccaaagccatgcagaagaacgaggagagtgataaaggcacccaggccccctaccctcagcgttaccaggaatcagagtgctgcgaacttcagtctatagctaagtacagaaagaaagcagcagagcaagccctggaccccaccgagtagagaaggtcaagtggagactccgtgcaaaagaaaaagaaggcagcaagagcctggatggggacacaaataaaatgatcctgagagagagtgaaccctgccctggtgggaaaatactgcgaagaggtctgatgcccagtagatcagagcgctggctgctgccagaattgaaagcaaggtgttttgggggcacccggctggctcagtcggaggagcatgagactcttgatctcagggtcgtgagtttgagccccacgttgggtatagagattacttaaaaataaaatcttttttaaaaaagaaagaaaggaaggaaggtgtttttttgaatgtgtgcagctggagtagctgtcttaaaaaggcaccagttctgggtgacagggacgactggggagggtggtggctctgggaggcttgctggtgaacagagggaaagacataaactgtcagtgaagtaagggattaagtttacagaaacgagaagatccagtaaattaaatgcctcagtctccccacccccaaaaaggtgtcatcggtttgcccaaaatgtcacttcactcttgcaacagaagacagtgctcctgaactaagaaacaaagtaagtcacccaaacttctcacctggtctgccaatgcctagtattgctggtcaaaataaacagaagtaggacgcctgggtggctcagccattgagcatttgcctttgatcagggtgtgatcctggagtccagggatcaggtctcacatcgggctcctgcagggatcctgcttctccctctgcctgtgtctctgcctctctctctgtgtgtgtctctcatgaataaataaataaataaattaattaattaattaaatctttaaaaacaacaacaaacaaaacaaaacaaacaaaataaacagaagctacctctggaagaacagagaaaagaagacgtttatacaaatccactctgtaaaaaaaaaaaaatgagaatcaaaacatttcagctgaaacttctacttataaaatagataagtcatggagatgaatagtacagcagagggaatacagccagtgctaaaggagtaatgttgtgtggtgacagatggtgactacacttaccatggtgagcattgaggaatgtgtagaattgtcacatcactgtcatacacctaacactagtagaacattttgtgtcaactatacttcaataacttttaaagtttatttacttattttagtaatctctacaactaatgtggggctcaaactcatgaccctgagatcaagagtcgcacactccaccaacgaagccaaccaggcgcccctgcataattaaaaaaaaaaaaaagaaaaatatttcatctgatgagaagtctcctccagaaaaataacaccaggcagaggacaattctgacacaacacctcaacctggactaaatattctttttaaaaaaaaaataattttatttatttattcatgagagaggcagagacacaggcagagggagaaacaggctccctgcaggagcccgatgtgggtctgggactcggtcccaggaccctgggatcacgacctcagcttaaggcctacgctcaaccactgatccacccaggtaaccctggactaaatattcttaaacaaccatttgcagagatgaaagacattttttttaaagattttatttatttatttatttatttatttatttatttatttgagagagagagggagagagagcgcaccagcagggggagcagcaggcagagggagaggaggaagcccactcccgatgagcagggagccgaacgcaaggctccatcccagaacctgggatcatgacccaagcccaagacagatgctcaaccaactgagctacccagacaccccaaaaaacactttaaatcagaaattttggaacatccagcagaaatgggccaaaaaattagaagcagaaataagagttaacaaaaatcaagaaattgaaaaaagaaagtcgaagtcttctcagaagtgatgattaaaaggcaagatacttaagagaaattaaattgaactgaaaatataataagaggcattcatatcaaagaaggaattaaaagaaccaagaaaacaaaagtaaaatcaataataatgtaggggcacctgggtggctccatcagttgggtgtctgacttctgatcttggctcaggccatgatctcagggtgacgggatcgagtcccacgttgggttctgtactcagcacagtctgcttaggattctctgtctccctctccctctgcccctccaccccttaaataagtagatgaagctttaaaaaatcaataacaaagttaaaaaaaaaagtgttagagagaaagagatggctgaagaagatatacaaagagaatacatcatgcaaaccactggagtgcccaaaaaagaaaaaccaaacggttgaaaagaactaatatcaaacaaaagtagagctccctcaccccccaaaagaagaaactttctagaaatacacaacaaaatctacacattgaaggggcatatcaaatacttagaaatgttgacatggaatggctgtctctggggtaaatcttaataaatttctcccatttactgggaaaaaaatggtgggccccaccctaaccagaggcagctcagccttcccagggaagaagagagaaactgatgtgggtgccccaagtgtggtgcagggagcctgccgtgccctccaggtagcattcttgccaggaatattttcacctgaatctgttcatgaggagaccactggataaatatggattggaagatactgtgcagagacccctggatttttcaaaatcggcaacatcatgaaagacaaaagacacggggcgcattctaggacacggcggagtcatgacaactcagtgcactacatacctttgattggttcctggatttttagaaaagagttataaaggacattactgggacaaagtttaaatagagactgtgttttaggtaatattactgtgttgaccttaaatttacaaggtttgggggcgcctgggtggctaagcagctaaactttgcttttggctcaggtcatgatctcagagtcctgggattgagtccgcagagagcctgcttctccctctgcctcttcctctctctgtatatgtctctcatgaataaataaataaaatctttatttttaaaaaatattttatttagggcagcccgggtggctcagcagtttagcaccgccttcagcccagggcctgatcctggagacccgggatcgagtcccatgtcgggctccctgcatggatcctgcttctccctctgcctgtgtctctgcctctgtgtgtgtgtgtgtctctcatgaataaataaataaattcttttaaaaaaaaatcaggaggttattagctggagatgagggaagaaaccatggatgttctacccacatggactgcacaagcttctgagtttaacttcttactgcttcccacatgaaaaggggctcgaccactgctccctggattctagtttcaaaaaatccacagggagggatccctgggtggcgcagcggtttagcgcctgcctttggcccagggcgtgatcctggagacccgggatcgaatcccatgtcgggctcccggtgcatggagcctgcttgtccctctgcctgtgtctctgcctctctctctctctctctctgtgactatcataaataaatacaattttttaaaaaattcttaaaaaaaaaatccacagggaagggatttattctattctcctggatccagctagctttggccagggttaaggtgatatgacaggaccaatccagaccaggtgcctcctccagaaccagccacctgtggccgggggtttgggtcctataagaacgtggctgctgtctatgttacagaacggatcttcagaacaggggagattctgagcagacattatccacagtgcagggtaaacgcaggatatcttgggcacccagaggagaagcaccaggcttggggcccagggtggcggggggggcgggaggcaagggggcgaatgggagctgcccgggcatttggaggaggcttccagaccttggagaagcctgttatgatgggcattccagacccgtgtggagcctcctctctcacctcccgcctccccttcctccacccacacctgcagtgagtgcagctgggagacctcacagtgcaaaggtcagatttgggggctgggtgtccaggccattgcaaatgtgcacatgtggctactgatacctgtccctacagggacagaagctgctccctcctccccaggagagttctcaggacagtggatggaacagctctgtcctcagggggccccacacggggccctggagtcctgatgggtttccctgcccctctctcaccttggcagcttccagctcggcctctgatcactagtgaccagcagagggcgcgcccacaccccttttggccatttcaagccccgtcctttctcctatcaattccttccttataagggtgctaggaccctggcaggtgtgaaggaaggaagtagaataacttactgagcacctaccgtgtcccaggcactgcgggctatttcactatcccgcacacttcatttgccccatttacaagggaggagacgggctcaggaagatggtcttcagggacattttccatcaggtgtacacagctcctgagaaaggtccaccctcactcactccgcaagctgggggcttaggtgaaaaggcctaacgaaagcagtaaggggaaccaccctgctgcctctcgatcatgtgcccccagccaggcctgggctcagaacacccccgggaaccgccacctgtgtttctgccctggccagcctccctcttcctcactgagtccaagggtttgctcctctgggctccaaggaccttggctgtgagctccccctctcctgggcgtgacccccagagagaggatgggagggcagaagggagagcgcctcccccccccccccccaggatacgacttccagtggggcacggattgccagcctagagctcccttaatgacattagcagttgccacacggagcccagcaaggacaggggctcagcctcactctggggccactcatcccctagactctgtgccactcctcacctagggcctctagctgagctgggcacttgggggcacggaatgggtactcttggcgaggcggctctggccactagatcccaaggcgctcagctctgtgggactctatcacagtttccccccagatccaagcttcagcctcccctcccataccttcccaccatcgtggcagatcctgtggcttcctggtgattttcagatacaaaaaagcccagtcccatctagtgccaacttaaactctacctctcagctaatcagacgctccctctgccctcatggtggggtagggggaggctatgggggaaagagaaaaaagatggggaggagctctatgtttcactgccccctggcattatctcctccttggggtgtcaatgtctcccttccctgtggctggtgtccagagcagtgcctcttgtaggatgcatgtgggtggcagaggcctggctgggtctgttcagtgccctgtgcacgcctccaccccctggggcccatcccaccactgctgctgctgagggtcctctgcccgtggccagccctcctaggggatgacaaacaaaatggccctagcactcccacagggtctactcggggtccaggggagactccctcatcctattcctgcctgcagatgtccccactccacccccacccctgtccactgctcaggtgggcatgaggaagatcagctgggccactgagaaagcagatgtccagccagagaatgagatgccagtctccactccccacgggcaccctgcccattgagaggaatctctggcgttcatcttcatggctggccctcccccctatgcccttgattcatgtgatttcttggacttcctaggctcttgcccataaagacccaggtgggagttggggggcaggtaagggttgggataatagtgataataataagtaataataatagcagatatataccgcttcctaggtcctggtcactgttctcttttacatgtactgcctgttagtcctcagcaaccctacaaggtgggcaccatttcgcggacagggcatctgaggtccagggaagttcagtaggtccccagttccctggctctgttactacaccatccctgctggtaccagaactgtgggctgaagcagaacaagttcagccgctttccagcagcccctggaggggcaagtctgctgcctgggcagagtcttctttctccagaatgtgaatccaaatgcctctttgtcccagctttggttcctaagtaacagcaggaacagggtcttccagcattgtttttcacagctggccagcacctgccgtttgacctttccttctccaccaccaagaccacacattgcatcttgagtttgtgctcaagtgagctcagtgagtgttggcagctgggacacctcacagtgcaaaggtcaggtttggggactgggtgtctgggccattgcaaatgtgcacagatggccactgatgcccgtccttataattggggcctgtctaatccttacaaccctgcacggagcccattttacagaagaggaaactgagactcgcctgagaccacacagcttgctggtatcaggaccagtccaagaaggatatgggatgcctgactctaaatctgaggcctggcttgagtcacttattcaaaccatttcttgccaggtgagtgctgggtgctgaggcagcccctgaaacatcacagggcagtgaggcagaggcagaggatggtacccgtgtggggactccagagccactgccccgtcgtccatcagggccaccacagacattctgcacagcaaggccaggctgcttttcttggggaaggtacatgtttccctcacggttaccagagcagaggcaagactcctcacccactcaccgggtccctgcttttgccaaatccaacacgtggagatttcatttcacaaaaaccaatgaaccggggcagccccggtggcgcagcgccgcctgcagcccagggcgtgatcccggagacccgggatcgagtcccacgtcgggctccctgcgtggagcctgcttctccctctgcctgtgtctctgcctctctctctctgtgtctctatgaataaataaataaaatcttaaaaacaaaaacaaaaacaaaaaccaatgaacctgggtggctcagcggttaagcgtctgccttcggctcaggtcatgatttcagggtcctgggatggagccccaccccccccaccccacctacccccgcatcgggctccctgctcagtggagggtctgctccctccctctgcccctgtgcccattccatgctttctttctctcaaataaataaataaaatattttaaaaaatcaattaaggtgaggttatttgcttcaccaaaaaagtgaatgcaggatttttaaataatacatttgttttatttttttaaatatctagatggcaaaacatttttaaaatacaaggaggcaggacagccccggtggctcagcggtttagcgccgccttcagcccagggtgtgatcctagagacctaggatcggtcccacgtcaggctccctgcacggagcctgcttctccctctgcctgtgtctctgcctctctctctgtctgtcatgaataaataaataaaatctttaaaaaaataaaataaaatacaaggaggcagaaaacaaaataataaccatctatcatctcaccgtgtaagaggttagacagtaaaaggcagagaagctgagcagcacgggaggatgtgcaggcgcacgtgatcagaccacagatagctcgggactcctgcaatccccaccctctcttgcatcttctttggtctcccagcaccttggctccatgctctgcaggcattctccccatgtgtcggaagtaagactgctgcctcactgagctcccacccttatgatgctcccaagtggaagaagcgcctcttcccactcaaattcagaattccccagggcagggctctaattggacatcttgggtttcgtgacccaacctgcagtctgaaggacggagctctgtaattgccagtcatgtgactgggctgggggaaaaaccagaagttctccaggagaaggggctgttcttcttgcagacaaaaggattagatgaccactttataccaccagggggaaatcatttttaatatctggccttcagtgcaggcaacagaacccatgcaggatggtttgtatagaaaggaaattattagagaatataaagagtcttctgtttctggcattatagcatccgggctgaggagaacaactaaactctgaaaaacatatttatttgaaatatagccaatctgacaagaggtaagggatgtccctgagcataccgccttctggacaagggattggacctggcaggggctggggcagcaggcaggcagccagatagatttccttcttttcctgggaaactgagccttgagccaagcccaaaacagggaaggggagtgttggggtccctcattcaaggcaagatgaagtaaccccatatcatggtgcttcctggtaccagcggaagtagaaaaacaaacgctatctgtaggactgctcccccaatcctcaactgagacccacaggattcctaccaattttaaaccagcaataaactcacaaagatgacaggaacacaaggaagcaagtgaccacgtctgtgagtcagcagaaacaatgagttgcaggtttagatccctaagaacaaaggtggaaggattttcagatacaaaatatagaacatacatttatgaaagacttaaagaaataaaagatgcagggcacccagctggctcagttgctggagtgtgctactcttttttttttttttttaagattttatttatttattcatagagacacagctagagagagagagaggcagagacacaggcagagggagaagcaggctccatgcagggagcctgatgtgggacttgatcctgggtctccaggatcacaccccgggctgcaggtggcgctaaaccactgcaccaccggggctgccctggagcatgctattcttgatctcagggttgtgggttcgagccccacactgggtatagagaccactgaaaaataaaatctattgcggcacctgagtggctcaggtggctaagcatcggaggggcttaggtcatgatctcagggtcctggattgagccccacatcccactctgcactcagcagggagtctgtttgtccctctgactctcccctggcatgtactctctctctctttcaaataaataaataaaatattttaaaacaaagtaaaatatttttaaattttcataaataaataaaagatgcagtcatgaagaagccattcaaaattaggaatcaacagatggattttaagatagaacttcaaaaaatgaaataatggttcaaattaaaaactttactgaagggatacctggatggcctagtcacttaagcatctgcctttggctcaggtcatgatcccagtgtgctgggattgagccccgcattgggctccctactcagtggggagcctgcttcttctccctctccctctgcctgccactcttcttccttgtgctctctctctgtcaaataaataaataaaacctttaaaaataataaacaaaattctaaaacctcacttagatattagagacagccaaagaaagaatcaatgagctgaaaccacatccaaagaaatcatctggcaaacaacacacagagggaagaaaattaagagtgtaaaagggattttagggtgcttgggtggctcagtcagttgagcatctggctcttgacttcagcctcaggtcacggtctcagagttgtgagatggagcctcactctgggctccgtgatcaacacagtctgctcatccctctccctctcactctgcccctcgccctgcatgcacatgctttccaccataaaataattagtaattaattcataaaaataaatctttaaaacaaaaagttctgaacttcaaaaaaaaaaaaaagaaagaaagagagagtgattttaaggggcacctaggtggctcagttggttgggcttctgactcttggttttggctcagtggtggtcttagagaggtgggatccagccccaagttggtctccacactcagcatggagtctgcttgggattctctctctctctctccctgcctctgcccctccccctgcttatgtgggcatactttccctctctctctcaaaataaataaaatatttttttgaagattttatttccttattcatgagagacacacacagagagaggcagagacacaggcagagggagaagcaggctccatgcagggagcctgacgtgggactcgatcccgtgactctgggatcatgccctgagctgaaggcagacgctcaaccactgagccacccaggcgtccctaattaagacatttttaaaaagagatttttaagggacttctgggtgactcagcagttgagcgtctgccttcagctcagggcatgatccctggagtcccaggatcaagtctgcatgaagtctgcttctccctctgtctgtgtctctccctctctctgtgtctctcatgaataaataaataaaaccttttaaaaattaaaaaaaggggatccctgggtggctcagcagtttagggcgtgatcctggagtcccaggtccaagtcccgcatcgggctccctgcatggggcctgcttatccctctgcctgtgtctctgcctctctctctctctcatgagtaaataaaatcttttcaaaaaaatttttaaaaagattttaagagatgtggaggatagagtaagaaaatctaacatatatttactacaatctcagaaaaggagaatagagaaaaggaggaaatgaaatacttaaagacataatgacttcgcaggctccagaagtgatagataacataaagtcactaagaaagcatacagtccaaccaaccaaataaagagaaaccaatgcctagctgcctcattgtaaaactatagaacaccaaagacaaagagatcttaaaagaaccagaaaaaaagagacagatccacctagacttgagagtcacaacagatgccagggacagtggaataatatcagtaaaatattaagggcaaataaatgtcagattagaattatgtgcctgggaaaatcacctttcaagaaccaggatgaggggcacctagatggctcagtcagtagagcatgtcaccctcttgatctctgggtcaagagttcaagcccatgttgggtgtttagattacttaagtaaataaataaaaatcaaaaagaaaagaagaaccaggattaaataagatcatttacatataaacaaaaacagggagagttttataatctgacaagcccaagagttgtcaaggatgtggtgggaatgtaagtgggtgcctgagtgtaaatgagtgtaacctaggacattatctagtgaaactgaaaaaatgcctaacccacctgtcagtaattccactcttgggtaaattacactggacttgagaaatgcatgcacacatacaggcatgtgtacatgcacacacacacacgcatatacactcatacacagaggagatgtactaaaagtgctcatagcagccttgcatgtactagcaatccacacacccatcagcaggggactagataaataagttataacatatcaatatgataaaatacgatatagcaataaaagtgagtgaatcatacttatatgcaacaacctaaatgaactgtacaagcgtttatgctaagagaaggaaacacacaagaacacgtgcaatatggttcacctgcataaagtccgaaacaagcaaaactaacctctgttatgtcagattatatatagctgaaactgggacgcctgggtggctcaatggttgagcatcttcctttggctcagggcatgatcctggagtcctggaatcaagtcccacatcaggctctctgcagggagcctgcttctccctctgcctgtgtctctgtgtctctcatgagtaaataaaactctcatgtaaaaaaaaataaaaataaaaataaaactctcatgtaaaataaaatctttaaacatttatatatatatatatatatatatatatatatatatatatatatgtgaaactaaaaagaaaagcaagggtatgattaacataaaagaacagttactgagtcatgatttaaaaaggaacatattgggaatctagtgttcagtttataattattctgtccacttttgtcttaggcacctttgtgtacatctgttatattttatataattgttcaaaagttccaaacagggcagcccgggtagctcagcagtttagcaccgctttcagcccagggcgtgatcctggagacccaggatcgagtgctacgtcgggctccctgcatggagcctgcttctccctctgcctgtgtctctgcctctctctctctctcccccctctctgtccctgtgtctctcattaataaataaaatctttaaaaattccaaacaaaacacaactgggagttcaaaccattatcaaacatacactaaaggaaatacttcaggagaaaggaatataattccagaagatgagactgaaaggcataaggaaacagtaagtgaatcaaatgatgaccatgtgagaaaaaaacaaacaaatcctattatataaaataaggtagaatttaaaggtgcaaaccaaaaaggatagacctaaaatgcagaacaaaaataagtcaggcaggagagtataaccagcatccaaggattctgaggtctttcttgcattattcaagaaggatattaatatatcgctcaatggtacatcttcttaagctacatatggattttttaaatcctgctacatattgtttacaaaagacatatccaagacataagacaaagaaagtttgaaagtaaagggatggaaaatatatagtaggcaaatattaacatcctcccaccaccaaaaacttagcatacctttattaatatcagacaagaccagttttttttaagatttatttattcatgagaaacacagagagagagagaaaaagagaggcagagacacaggcagagggagaagcaggctccacgcaaggagccggattcgggactcgatcccaggtccccaggatcacaccctgggctgcaggcggtgctaaaccactgcgccaccagggctgccccagacaaaaccagttttaagataaaaagcattatcagggatacagaaagtcattacataatgacaaaagtcaaactggttaaaaaatataacgttaaatgcctatttttttaaagcttttatttatttattcacgagaaacacagagagaggcagagacacaggcagagggagaaattggctccctgcaggaagcccgatgcaggactcgatctcaggaccctgtgatcacaacctgagccaaaggcagatgctcaaccattgagccatccaggtgccccatttaatgtctaattagataacagttgaatataaaaggcaaaaactagacagaaccatgagacaagtaaagaatccaccatcttaacagaacatttcaataaaccttttccgattagtaacaaatcaggaagaaaaaaatccagcaaagatatagatttgaatgacagaattaacaaactcaatctaatggacatgtaaacaagcctgcaggacaaaaaaatgttagactactcacacaaaacaatcacatgctaatcagagcaagtctcaaaaaatagtaacaattcagtatcatggagaccatagtctttgaccacaatgtgattatgtcatcaggcatcaacaaaaagggtaaatacaaagtttctgtacatttaaaacacactctcaaaataaactaggtttgagttaggagagcacatgggcatatagatgaaaatacactggccatatgttcataattggacctggctgtaggtacctagggactctttacgtattctcttctcttttatatatattttttccatgataaaaagtttttagaaaaatactcaagaataacatgtatgtgtcaaataattaaaagtaattttaaaatattttacaataaacattaatgaaaatacaccaaaacttggtggctacaatggaaacaatgagtagagggaaacatatcacattaaaagcttaaaaaagaggaaagtctgaaaataacatgttaactgtccaagttagagaaagaacaaccacataaattcaaaaacagcagcagtcagaaaatgacaaagataagagcagaaattaatagacaaaatgaacaaagggtagtggaaggggaggtgggccggcggatggggtgactgggtaacaggcactgatgggggcacttgacgggatgagcgcggcgtgttatgctatatgttggcaaatcaaactccaataaaaatatacaaaaaaaaaagaaaagaaattaatagacagaaaacaatgtaagagagaaaatcaatgaggtcgaaaattggtgctgtgaaaagaccaattaaattggcaaacctctggtgacactgactgagagaaaaagggagaagtcacaaataaacaatgaggaatacaccaaataggtagccccctacgcagcagtgggaggaaaggatgaaggaaatgtggacacctgtggaccccgggtgggagaggtagagtctgggtcagctcaggtgaggtacctaaggtcactccgctggccctggggtggagcatcagaacctcagccacttacaaccatgttccagagagcccgagcccagctcaccaccgtcttcaccgagaaagaaaccactagtgcccgccccccaccgtattgccactcacagctcctcccaagtgtctgagaggtggagcctggtcacagcctgtgctctaggtgggagaaagactcatggttctaccttcttctgtgatcaagcagacgtctccacatttggggagtgtggtcaaaagatgctagaaaggggacacctgggtggcataatcagttgagcaatctactcttggttttggctcaggtcatgatctcagggtcatgaaatgagccccaagtcagtctccacgctcagtgcagactctgcttatctctctccctctgcctctgctcctcctcacactcagctctctctctctcccccaaataaataaataaataaataaataaataaataaataaataaaatcttttttaaaaggaggggcacctgggtgccttagtcagttaaacatctgcctttggcttgggtcataatctcagggtcctgggatcaagccctgctttgggctctctgctcagcggggagcctgcttctccctctctctttccctgccactccccctgcttgtgctctccctctgtctctccatggcaaataaattttaaaaaaattttttaagtctgaggttttgccttacttgcaagctaacaagttagtctgccacagtttcatgggtactcacagaagacaggggactcgtgggtcagagacaaaggactttactacttcttcttttagggctttattgcttaaagcacagcgggcatcctgagtttcatgtttgcgttgttcctcttgcctcacaaatcccatggggtggcatgaaggccaggtatgttgtgccagtacacagagggtctgcatcacagctgaggagctcagtgaactcaagcctttttaaagaaactacaagaaaatctgcccaacctttgccctgaaagaagacattattatattattatatgggacagtaaacctaccctctgctctggagatagctgttatctccatcttccaagactgttccatatataaacatcccttgtccagaacaaggtgtgtgtgttgtggaactcaagagtaggacaggccagggcactgcaagcagcggctctcagagaagcagggccggacatggtcaagaaccaggtcccacagcagcagaacaacgacaagggcaagggcaaggaccaggcccctctcatgttttcctgggaccaggggaatctcagattcttatgtgagccaatataatggggatagagaatcaatatcagctgctgcccgttgtcctgccaacccggcagggagtcaattttaagtttattttgaaaaataaagaaatgtgacacttcaggcctaggtgttttggaaacagttcccacctctgtctaatggcctgtcccctctctctctctgaggccacacagtggcccacccatcatctgttcctggctccagccccattccaagtctttggcctccttctatcccaagacaggtagagcagtggcagagtgaggggaatattatttatttttaccccatctcatcccaaaaggattctaggtaaccaaaaaaatacatgcaagacaagatttgttaaatccaataagaggcaaaattgggataaagtggccttaatctggtaccctgttattccacgggtttctggattgggccctgagtttcctggtggccagggcaaagggggaagcaataacatcatcggatccaaagcataaatacaacatggttattcagaagaaagttgtccattcctttactcacatggagagagagttcttccctggtcctctttgggagaacaccatgtgatgtagtgaaagcatcctcaacaatatcccttccacaaatacaacagtaggtctgttgtgactcctccccaggtatcccttgctgaaagctacatgtatcctacactcaactcaatgagcgaagttttaaggggctagagaaagtctagccatgggctcctcagaggtctcccagaaagatttagaggttcaactcggtgaccagggcctcgcctgctggcctgacttgactagacagacctgctctggcctcattactgagctttgtgcctgcaatggagtttcctcgatggctcttctctaacaactgggcctccacactgtaaccttaacccaaaatccttctggcttcctcccctacacctgtagcagacatcactaatccatcccagcaccagtcctcagtccctgtccaggatcagatgaaaagaagactgtaacagagtttgcaatcagcataaccaacaaaacatacccagaacacctacatatcagtaagaaaaacataaatggcctaaaagaaaaataggcaaaagatctaatgagaactttcaaagaaagtaactgccaatggccaatccacatgagaagttgttgagtctaactagtaattaaggaaatgcaaattaaaactagaataaaagggatccctgggtggcgcagcggtttggcgcctgcctttggcccagggcgcgatcctggagacccgggatcgaatcccacgtcgggctcctggtgcatggagcctgcttctccctctgcctgtgtctctgcctctctctctctctctctctctgtgactatcataaataaataaaaaaaaaatttagaaaaaaaaaaaaactagaataaaataccatacccaacagattggcgaagactaatacacctcatggagcatgcagagaaacagaaattatagttagctgtaggagcgcaaatcagtgctaccactttggagaacactttgataattcttagtaaagctgaagatgcataaacattatgacccaaaatttctacttccagatgacaacggcagagaaactcttctttgcatgtccacggagacatgttcaagaaggttctctgtgacgttgattataatcataaactattaccagcaactattcttagcaggaaggtagataaattgtggtcatcataagataaaagacacagagagagtacaatgaatggattcgagttgcatacttcagcactgatagatctcagaaccatagtgttgagctaaagtaatttgcaaaaaaataaaaaataaaaaataaagtaatttgcaaaatgatatgtaacgttatgataccatttatgcagaattttagaacacaaaacaatattgttatggatatatacttatttggtaagttgccaagcatgtttgtgaatgaaagaatacttcaaggaggggagaaagagggaggtcaagggtgggcttttagttttttccatgacattttttcttttcaaaagaaaaataaataaataaggcagcccgggtggctcagtggtttggcgccgccttcagcccagggcgtgatcctggagacccgggatcgagtcccacatcaggctccctgcatggagcctgcttcttcctctgcctgtgtctctgcctctctgtgtgtgcatgtcttccgtgaataaataaataaaatcttttttaaaaaaatatatatatacacacacacatatatattctggggaaaagagccaaaacatttcaaatagtctcattagagagtgataggtatttgttattcattttctatatttttctgtatgtttcaaatatttcaaaatttgtaattaaaagcaaaataaaaaaaataaaataaaataaaaacaaaataaaggggatggctgggtggctctcagtggttgagtgtctgcctttggctcagggcatgatcctggggtcccgggatcgagtcccaccctgcggggatactgcttctccctctgcctgtgtctctacctctctctctgtgtctctcatggataaataaatagaatctttaaaaataaaataaataaaaacaaaataagaggcactggggtggctcagtcagttggctgtctgctttcgactcaggtcatgatcccagggtcctgggatgcagctctttgtcgggttccctgctcagtggggagtctgcttcccctctccttctgcccctcctccttgctctctcttctctcaagtaaataaataaaatctttagaaataaatatgcaaagtacaaagaaagggtgctacaatcccatcgtgacgctaggcagagcaggagcacgacagcgagaggtcaccatttctgtccctgcccagaaattccagtttctcggactaccacccccacacacaccatcccaggactcaccacacgcacctgaccataggccttgctggcaccgcctggccccgtcacctgcccctgcattcctgcaggaacctccccactcaccaccatgatctccgagtagatgcacatcccggttggctgaccatcactcctcatcacacaggctgagcagggaccctagggtttaaagcccgaagatctgggttcaaacagcagttctttcacaccttggctaagcgaccctgggcaagtcccttgacttcatgtcaggggtgataaaacaataggagggaaggaacccgggtccctgacatttgtgcagctggtctaccaaccctaaaaagcccccctctgtctcactgacatttgagagaaagcaattctgtcttgtgtaagccactactaatctagggactgaggtaattccactcttcccagaatgccccacgcctcccctcagagatcttggcttctcaaagtgtggtccaaggaccagcagcacgggtctcagctgggaacttgttagacatgcagaatctcaggcaagatcccagacacttacctatacctatatgttggaaggtgaggagcccagcttcagggctaggattccgagagggactttcctgttgccatggagctgctaaagctgcaaaactgggaacactaggagctgcatgctcctttgttctaaagctgctcccggggcaaacaggcctgctgccatcattgccaccagcttcccaggagcctcagtgacagaaccacggcagggctcccaagcagagtgggagtgttgtggcttctcccttttggtggcccccacccgccaccactagcccccaccccaggccaggcaagaaaagggctcccaggacctgggagggatgccccgcgaaaaggggaacctagcaagtgtctccttccctggaggggcagctcaacaatcagcaagcaaccatcccccaaaccacctgaacaggacgagggggtgaggggttgcaaagggacatgccctttctcccaaggggtgcagttatggcacgccaagactgccatgtcccagaagacatgactctgtcctggggcaggcgatctttcttcaggggtgctgctgggagtctccgcatttcctggtgccctggtgcccgacacaggctggccccttccagtcccaggcccccatgctgccagactccccttgcccgtagaggcttctgtgagactcctgaatccacgcatggcaaacacacatctttgccaaacggtggagggcaggctgccccttctctcagcccctccaacttttatctcctcctgctcagagggaggatggttcaggaaagccagcacccaaattgcaggaagtgtggagcagagagcagacaaaacaaaaagcagaaggatggaaattgttcaatcataatagcaaaaatgtggaaacaactcaaatgtccatcagctgatgaatgagtaaataaaacatggtttatccttttttttttaaagattttatttattaatttgagataaagagatatcgagagagagaacctgaccagagagaggggcagacgtagagggagaagcagactccccactgagcaggaagctccatgttgggctggatcccaggaccccgggatcatgacctgagccaaaggcagacgctcaaccatctgagccacccaggtgccccaaacatcgtctatccttataatggaatataattcagccatcaaaagaaatgaacaccagcacgctaccttgaatccatgcccagcgaaagaagccagacacactctatagggtatggtcccgtttatgtgaaatgtccaggagaagcaaatctatagaaacagaaagtagacgagtggctgccgagggcggaggggtgaagtggcagctaaagagggggtgcagtgtatgcatctgttttggacaaatgaatatgttctaaaatgtgctggtcggggcagcccgggtggcgcagcggtttagcgccgccttcagcccagggcgtaatcctggagacccgggatcgagtcccacgtcgggctccctgcatggagcctgcttctccctctgcctgtgtctctgcctctctgtttctcatgagaaataaataaaatctttaaaaaaataataaaataaaataaaatgtggtggtcggtgcacaactctgactatagccattgaattgtagcatactttttttaaaaatattttatttatttatttatgagagacacacagagagagagagagaggcagagacacaggcagagggaggagcaggctccctgcagggagcccaatgtgggactcgatcccaggaccaggatcacaacctgagccaaaggcagatgctcaaccactgagccatccaggcatcccaaattgtatactttaaataggtgaactgtatgggatgtgagttatatttcaataagctgtttgtagggcgcctgtggggctcagtcagttaagcgtctgctttcagctcaggtcatgatcccagggtcctgggatagagtcccgcattgggctccttgctcagcggggagcctgcttctctctctgcctctgcctctcaccctgcttgtgctctctctctctgtcaaataaataaataaaatattaaaaagaaaaaagttgtttgtaaaatttttgtaaattttttcccttaaaaagacaagcactcaagagcatttttccaggggtgcctggctaacccagtccgtggagcatgtgactcttggtctcaggatcgtgagttcaagccccatattgggtgtaaggattgcttaaaaataaaatctttgtggggggaaaaaagagaacatttctctgaagtgaaggatatgagtttccaaactaaaatggcctgtcaggtgtcaatacaatggacaaaaatagaccctcaccagagcccatgatcgtgaaatttcagacagggatattctacaagctttcgaagaggaaaaataggtcactttcctaaaaaaggtcaggactgagaacggctcccaactgctccaaccttcgaaacaagataccagggaagcctgggtggcttagatagttaagtgtctgccttcaggtcaggtcatgatctcagagtcctgggatcgagccccatgatctcagggtcctgggatcaagccccacattgggctccctgctcaggggggagtctgcttcttcctctccctctgtgatctctctcgctttcacacactctctcaaataattttttttttaaaagagtgcctccagctccagaacatttagaaaaaaagaaacaagaaaccaatggatcagcccttcaacatcctgaagaaaagtgatttcccacccagacacctaagccaggcagagagtagcaatcaaatgtgaggataaaccaaggacattcagggacctgccatgtcttgaaagggttctctcccaccagcccttctcagaaagttagaggatgtattccatcaataggaaggggtacaccatgggttacaggggaggggcatcaaccacagcagaggggaagggaacaccaggaagggatggaaaagggagagcctagggtccccgccaagaatcaggcagagggggcagccagaccatgctgtcttttaaaatagattttatttacttattcatgagagacacacagagagagaggcagagacacaggcagagggagaagcagagtgcatgtagggagcctgatgtgggactcgatcccgggtccccaggatcatgccctgggctgaaggcagcactaaaccactgagccacctgggctgccctgtcttttaaaataaataaaatatagtctatactcccctagataaaataatgagggctgattataaaaaacaggatgtatgggggcacctgtgtggcttagtcggttgggcatctgcctttggctcaggtcatgatcccagggtcctgggatcaagccccacatcaggctccctgctcagtgaggagcctacttctctctctccctctgcctgctgctctccatgcttgtgctcgtcaagtgaggaaggaaggaaggaaggaaggaaggaaggaaggaaggaaggaaggaaggaaggaaggaaggaaagaaagaaagaaagaaagaaagaaagaaagaaagaaagaaagaaagaaagaaagaaagaaagaaagagaaagaaagatatgttgtacgggaaagggcagcctggccgagctcctatccgctctcaatcacttgttgatgacgttcctcttgtgccccccaggtccagccacctctgtccactggggaccctcatgctttgacagctgataactgagaagcagaaattctgaggaacctgctcccccctgtacagtcctgctggacccccagccacaggccttgccatagagctgcagggagcaccaagttttcaggacttactcataagtttacagacttctccagagggggctccagtcccctctccggaaagctgaaggcagcccgggaccagaggctctgttcagatgacccctggcagccttcacccaacagtaacagacagcccttctgcggcttccacccagtgtgttcattgactacccttttcattcatttataggcaagtcctgccttataaaatttcctaagattttcttttgattgaggaagaaaatagagtggagagaagagtgtgcccagaagtcatgaagtcagagaagcaaaggaatacaagtgaaatgcaaagtttgaggccggaggttgcaaggagccgagccagccagctgagctggccgactgagccccgggcccggggggccattagggcaggcccgcagggggacacgtgctcccgagggtcatccctggactgccctggccactgccggcgagagtcctgcggggcccagggtcggcaccgctgccctcgctgccctccgctgcccggcctcggcctcgagccgccctgaagctggaagccccgcaggtgggcagggctggcccaggaggctggtctccatttccgggccgcaccgcggggtccgtcctgggctgtgaccccagctctccacatctcccctcggccactactcccctcggtcatgatttatttattttaaagattttattcatctattcttgatgacacagagagagacgcaggcagagggagaagcaggctcctcgcagggagcgcgacgcggggagggggtggggcccgggactggaccccgagcgagccgggcccggatcacgacccgagccgcaggcaggagcccatgagctacccgggcgtcccgggattcgatttatgatcaagagagccatgatgtgggtactggggtgtttttctcctcctggggctagaccgccacaggtctcgggggccctcggagcctcggttttacctcgaaggacaggaagagaggcggggcggggggtcgtcgcaaggtcaccgccctagagctcacgtcggcccaaccccagccgagcgccccgcgcccgcagcccgagagcaggcgcggcaacgccgagcacggccacgaggtggcgccaggaaaccgcgggaggcgcccaaacccagcatccaggctcctcgctcctcctctctcccgcgggcccggcccctccgcccgccgcccgcccccgggccctagttccccgagcagcccggcgggctggggaggggaagggggaagccgagcggccgccgggacgtcgtcgtggaaggagcttagggaccgcttcggtccagggccacctggaggctggactgcaccagcgacaccctggaggtgccgcgtcaggtgtgcagcccaccttccctgcgggagccctcgcgggagccttgctcctcctgcatcgtaaagggagagcacgggagtaggagaccttggggcagggcaccgcctgcgcccagctctgctgcgcctggctctggccagcctagtgtttccaggctctgccgggctgctgctagcgctgacccttccccaccacccgacgagactccatccgcttcccaggctgcacagctctcgctggcggagctcacatctgcacctgccacctcgcggccaagggtgctgaccactgtgctgggtcagagtcatcccaggcacacagcgcttgtcagaccccgaagcccaggctcctacagcctgaggaagctgggtcccaaggccaggctcccacccccacccagtcccacccctgaactgcagtctctttcatcgaggcccacaggccctgtaggggacgtaatcacaaggcctggaaagaacccgggctttggagcccatgcagacctggaataaagctccctctgcatttactggctgtgtgatcttgggcaagtcatctaacctctctgggtctcactgtcctcatctgtaaaatgagagcactcatacccaccttgggaggttgtaacttttagaaaccatacccatgaatattaaaaagttaaaaattaattaattttttttttaaagaaaccatatccatgaaagaatattcccggtgtagggcgagtgttcagcaaagtcagcttatcggagggcgcctggctggctcagcaggaggagcgtgtgactttttatttcagagctgtgagtttgagctccacgttggctatggagattacttaaataaatgaataaataaataaacaaactctgcttattggatattcatggactcctattttatgccaggccctctgctggggttcaagggaatccagagttgaatgagatgtaactgcagccctccaggaatgaccctctgggcaaaataaaactcatgcttcaaaattcaggcagcattttcctgatgctaaatgtggtggcattcaaacatttgtaacccttcagcctctaaacatgaggggcgcctgggtggctcagcagttgagtgtctgtcttgggctcagggtgtgatcctggagtcctgggatcgagtcccacatcgggctcccctcagggagcctgcttctctctctgccatgtctctgcttctctctctgtgtctctcatgaaaaaataaataaaatcttttttaaaaaataaaataaaataatagattaaaaaacaagccaccgcaaagagtggagctaccctttttgactctatactctgcaccaggttcttcacctacatacgttccccagatgcttagtgaagccctagtgggtgccaagtactgtgcagggacgtggggcacagccatgagcaggaaagtgtccgcacggaggcggagctgataagctaggggggaaccggtgacaaaggagtcaagacaaggatgcacttgtaattgaggtaagtgcctacaagggaaatggaagatcagtactgccgaggataccccgagggtggggggtgggggcgtctgcccagatgcaggcaacaagagggggtgtcatcaggaacaaattttaaaacaataagaacctactaaaagttggtctgctgcttattaacaccacataccagcaactctaaacagcgtcctccctcccaaaaaaattattctgttggtttaagacctcaacaattgtttccgttcctgttaatttttagtaatatacgtgtaaatttcaaattagtacatttgtattgcttatcctttaaaaaccattgtattctgcttagaagttaattgtgaaaattcccagtcattgagccactcccaccagctatccgtggtcatgtggatgcagaattgttcacgctcacttcagaggaatgttgtgtcttgaatctgaatccctgttgtactgtccttcatttaaacaggcagtttggggaaccctgggtggcgcagcggtttggcgcctgcctttggcccagggcgcgatcctggagacccgggatcgaatcccacgtcgggctcccggtgcatggagcctgcttctccctctgcctgtgtctctgtctctgtctctctctctctctctgactatcataaataaataaaatttaaaaaaaaaaaaaaataaaaaaataaacaggcagtttgaaataaacattgggagcatacctctgcgtgaccatttggagttcttatttgtttaaaaattaccaactgggaagatacctgaaagctgctagaatcgactctgaggaactacatgtggatagaagcgtaatttctggaatttatggtgaaatggatttttacataagtctctaccaaacttatccttatgtttaaggtttttcctaattatttttctatttttaaaaatattttctttatttgttcatgagagacacagagaggcagaaacataggcagagggagaagcaggctccatgcagggagcccgatatggggcttgatccccagatcccaaaggcgggcgctcaacggctgagccacccaggcgcccctcatgcatgccttctagtcatcaggaaagagcaaggggcaaaggaagcccacctactcccccagaagaacccaacacctgcctgcatccagtcagtcaggatttaaccatttggcccaaactagctacaagggagcctggggaaatggagtctttatttaaatggccttgtgccctgccactaacagggggtactctttctaaagaaggaaagaatggataatgggggaagggcacatgtctgccgtgccatcaagagaagcttggtctttttcctaaaagcaatagtgagccattgaacgttttttggttttgttcgttttttttttttttttttaagattttatttatttgttcatgagagacacagagaggcagaaacataggcagagggagaagcaggctccatgcagggagcccgatgtggggcttgatcccaaaccccaggatcacaacctgagccaaaggcagacactcaaccactgagccacccaggtgacctaaattcagtatttacaggaggaagagaaggccttccctgccatggccttccctgacctgtattgatgcagaggcaggaaaatgatgagaagaccgcaggtcaggggtcagcagacccggcctcgacacctctcttcctagaactcaattcttcatctgtaaaatggggtcaaggcaccaaccctactgtatagccgctctggttgcctctccaacaccattcctcctgattccctaacagaaccacagttttattggagagactatggcagaaactgccaatggccccaatatccattctctgttcttccatagaaatggaaattttggatggctaaagactacatttcctagcctcctttgcagtaaggggtggtcatgtgactacagtgagttgtgttacagcaggggaaccctgagtttagggaacctgaatctttttttttttttttaatttttatttatttatgatagtcacacaggagagagagagaggcagagacataggcagagggagaagcaggctccatgcaccgggagcctgacgtgggattcgatcccaggtctccaggatcgcgccctggccaaaggcaggcgctaaaccgctgcgccacccagggatccccgggggttaagatttaaacgtatgggaatgcctgggttgctcagtggttgggcgtctgccttctgctcggggcgtggtcctgggatcaagtcccccactgggctcccggaggggagcctggttctccctctgcttatgtctctgcctgtctctcatgaataaataaatgaaatctttaaaaaaaaaaaagatttaaacatatgattttgagaggatacattcagaccataacattctgcttccgcccccaaaattcatgtccttctcatgtcatcaactcaaaggtctaagtccaaagtctcatctaaatatcatctaagtcagatatgggtgagacttcctgtacaattcattgggctttgtgatatttatttttttttaatttttttttcatttatttatgatagtcacacacagagaaagagagaggcagagacataggcagagggagaagcaggctccatgcaccgggagcctgacgtgggattcgatcccgggtctccaggatcgcgccctgggccaaaggcaggcgccaaaccgctgcaccacccagggatcccaacctggatcttttaaaacagaatcttaacgaatttgccctttgacctggaggaaaacactatcttctaaggctgtttgctttatgaacttctttgagagatgtgcagaaacttgagggacctactgagaattaatgatttcccagcattgcagtaatattggattttgagggcagcccaggtggctcagcagtttagcgtcgccgtcagccagggcctgatcctggaggcccaggatcgagtcccacgtcgggctccctgcatggagcctacttctccctgcgcctgtgtctctgcctctttctctctgtgtatgtgtgtgtgtgtgtctcatgaataaataaataaaatctttacaaaaaaaatactgggttttgaatgagcagtagtgtaattacggccctgagatatgaagaggaattgtcagcagcttccaggagggctctcttctttcactgtatgttgttgacgtctggacatgacacttgacatcaggcagccctcttatgaccataaaaaacacggctgactccctggcaatggcagggttgaaggttgagaatagcctcagtagtggccgaggctggagagtcactcaaccagcaccggagccactcacctcttgccatcttgttacaaggaagcagaaatgtcctcattgttgaagccatctcagtcaggagtcagctggaggcatcctgaatcctgctcctgggcagcgtgcctccctcctagaagtgtcgggaggccacccagtacaaaagccaaggtgggaagtacttctccatgaggggcagtgctccacttaccagagggatgaggtgagacagctcagtgaggggttttcctcctcccaaactgcagattaaatagtccctggcctaccaacagaaaaccaaaccaactggcttgttggggccccttccagctctggggtctagggttgtttggtgccacctcactccaccccggcacactgctcctacgtcccctgaagctccagggagggacccccgcacttgcacttccaccggggtagtacctgtgggagtgggaaggagcaggaggccatttcccctccaggccccaaggggagcttcttctgcctcacggtggtggtcaccaccagaagccccagtgggaccctgctgcccgaccgtggggacagggcagttcagaggggagttcagaccgccatggggctactgggggttggtggaggggaccccaaggaggagcgtagctgggtgacacactcggcaatttcagtgtggcttggggctgcgggtgacagacggtttgtcagatgggttcaccaggactaatgggctgctctgttaccgcccacggaacatgctgggtgcagatctgaacatttgaaagggagctttctggggacacaggcttttaagccaaacatgaatctagctgggggagtggggtgggatttcaagcaccttgagcaaactggtggggcacgcttggggggaaagcagggattttatcactcctcacatcctcaagcgaccctcctccccattaagctcaaaagcaattattgagcacctgaagtatgcagataaaagacacaggactactcactgctggcttgacatctggaggcggcaggggattatcatttacctctcagctcaggctggtttcctccaggcagctggtccagagccacatcccaccccccccaaccccgctgcttgccatctcagcgggggttaccttcctgctatcccaggaggccctccaactcagcagttagccaccaccttcccccaaacttgtttcagtgtggatcttcccactcacccccctaggccgagcctagcacgatgccaggccccaggagctgggggggggggcatgccccaaaggcaaggaggaaggcagccccctctgggagagcccaccaaaagattaggttccaggaaaaaatgaatggaggccaaggggggggcatggggcggaactttgggggggggggggtgcaggaagaggggggctggcccctgagcaaggcccgtaagactcagtggcaaggttacatggaagaagctttagatgtccttagcgctacagctcggggaagcccctggagagctggagccaggaaattaacctcatccaggcacgtctagagatattgtgggttcggttccagaccaccgcagtaaagcaagtcaagtgaatcttttggtttcctggtgatataaaagttatgtttacactatactgaggtctgttaagtgttcagtagcatttcatctgagacagcaatgtacatacgataattaaaaaaaaaaatttatcacagaggtgccaggctggttcagtcagtacagcatgtgattcttgatctcgaggtcatgagttcaaacctcacactgggtatagagattactttaaaaacaaaatattgtattgctaaaatatgctaaccatcatctgagctttcagtgagttgaaatcactgatcacagatataataatgaataacaaatataatcctaatttaaaagtttgggaaaaaaaagaaagtttgaaatattatgagaattaccaaaatgtgacacagaaacaccaagagatggatgcctgggtggctcagtggttgaggccttcagctcaggtcatgatcccagggtcctgagatcgagtcccacatcgggctccccacagggagcctgcttctccctctgcctgtgtctctgcctctctctgtgtctctcatgaataaataaaatctgaaagaaagaaagaaagaaagaaagaaagaaagaaagaaagaaagaaagaaagaaagaccaagtgagcaaatgttgtttgaaaattatcccaacagacttccttaatgtagggttgctgcaacaaggctttactttgtacaaaatgcaatgtctttgaagtgcagtaaagcaaagcacaataaaacaaggtatgcctataaagctttatttgggcaattgtgatgtgcaagacaccagcttagatgttctacatatatttcctttattttctttttaagtaatctctatgcccaacgtggggctccaactcatgacccctagatcgagttagacactccaactgagccacgtatttcctttttaaatcctcatgctgtgggcagccccggtggcgcagcggcttagcgccgcctgcagccaggagtatgatcctggagacccaggatggagtcccgcgtcaggctctctgcatggagcctgcttctccctctgcctgtgtctctgcctctctctctctctctctgcatctctatgaataaataaataaaatcttaagaaaataaataaatcctcatgccgggacgcctgggtgggtggctcagcggttgagtggctgcctttggctcaggtcctgatcccagggtccttggatcgagtcccacatcaggctccctgcgaggagcctgcttctccctctgcctgtgtctttactgtctctgtgtgtctctcatgaataaataaataaaattaaattttataaaaataaataaataaatcctcatgccaaccctataagatggatatgagcatcccatttggctgggagacagaagcaccacaaccaccaagtggcaaagctgggacttgaatctcagactctctgaccccatccccagcaggagctaacgtttgggccacatgccttacagacaacattgcccataactagccacccttgctggaatatgtcacaggccaccactatgctacactgtctctcccctccactcctggaagaggcatcagtctttactgacgtaaatccttcaacacagggcacaccctccgcatagggcagcagccatgtgaatgaatcatcctggaaagagctcctccagcctccatcaaaccttcagatgactgcagtcctggccaacgtcataactacaatctcatcgcagaccccagctagcattactcagataagccacttccagactcctgactcccactcactgcattttggaatgatttcttactcatcaataggtaactaatgcacactccaatctgggtcccgcccctcctggctgtgggaccatgggcaactttacctctctgggcatatggtttctccagctcagacctttctgctaaactccagattaatgcaatcagcaaccaccattaaggtccttcaggtgtgggcacgtagcatatctcaaatacctctctctttgtttaaagattttatttattattcatgagagacacagagagagaggcagagacacaggcagagagagaagcaggctccatgcagggagcccgatgcgggacttgatcccagggctctaggatcacaccctgggccaaaggtggcactaaatcgctgagccatccgggctgcccctttcaaatatctcttaatccactttccaccatggctcaggccctcactgactctcccttcaattattgaaacagtctcctcattgattctcctgtcttgtataaggctgcaaataacaaaatcccaaaataccgtataaagaacttataaaactcaataccccaaaaatgaaaaatccaagtaaaaaatgggcagaagacaggcattttcctaagaagacatacagatggccagcagacatgaaaagatgttcatcacttaccatcaggggaatacaaatcaaaactacaatgagctatcacctcacacctgtcagaatggctaaactcaacaacacaggaaacaacaggtgttggtgaggatgtggaaaaaggagaaccctcttacactgttggtgggaatgcaaactggcatagcactgtggaaaacagtgtggaggctcctcaaaaagttaaaaatagaactaccttgtgatccaacaatcacaccactagatatttacccaaagaatacaaaacacaaattcaaagaaatacataaacttctatatttatagcagcattatctacaatagccaacttaatgaaacagctcaagtttccactgattgatgaatggataaagatgtgacatatatacaatggaatattactcagccataaaaaagaatgaaatcttgtcatttgcaacagcatagatggagctagagagtataatatctagtataatagctagagagctaagtgagataagtcagtcagagaaagacaaataccacatgatttcactcatgtgtggaatgtaagaaataaaatgagaaagaggaaaaatagaggacaaattaagaaacaaactctagggatccctggttggcgcagcggtttggtgcctgcctttggcccagggcgcgatcctggagacctgggatcgaatcccacatcgggctcctggtgcgtggagcctgcttctccctctgcctatgtctctgcctctctctctctctctctctctctctgtgactatcataaataaataaaaattttaaaaaaagagaaaaaaaaacacaaactctaaactacagagaaactgatggttactagagggaaggtggtgaaataggtggatgaaatacgtgaagagcattaaagaggacacttgtgatgagcatcaggtgttgtatggaagtgttgaatcattatttatgtacctgaaactagtattacactgtattttcactgaatttttaattttttaaaaatctcaaaacaccagggatccctgggtggtgcagcggtttggcgcctgcctttggcccagggcgcgatcctggagacccaggatcgaatcccacgtcaggctcccggtgcatggagcctgcttctccctctgcctgtgtctctgcctctctctctctctgtgtgactatcataaataaataaataaataaataaataaataaataaataaataaataaataaataaataaatttaaaaatctcaaaacaccagggatccctgggtggcacagcggtttggcgcctgtctttggcccagggggcgatcctggagacccgggatcgaatcccacgtcgggctcccggtgcatggaacctgcttctccctcagcctatgtctctgcctctctctctctctctctgtgactatcataaaaaataaaaataaaataaaataaaattcagattattaaaaaaaaaatctcaaaacaccagcagattacaactaagcaaaactgtatttccctttcacactcaagaagtccaaaggcagatagtccagagttagcatggcataccatggagccaagaactcaggttctttctttttttttaagatttcatctatttattcataagagacacacacagagaggcagagacataggcagagggagaaagaggctccatgcaggaagcccgatgtgggactccatcctgggactccaggatcatgccctgagccaaaggcagacactcaactgctgtgccatccaggcgtcccaaacccaggatgccttctatctgatgatcagcagcacatggatttcattcccaaagtttcctcacagtctaaaatagctgctagtgctccagccataatgtccacattctagacattagaaaggtggaactggaaaaacaaatcccttccctttaaaaacatttttattttccactgaccatatctagcaagggaggcaaggaaacagtctattttgaggttcatcatgtgctcagctaaaaatacagaaattttgtacttaggaagaaggtgagagcaggcatataggacaaccagcagtctgcagcaccctccaccgctgctgccccgtaaagggttttattattacttctgggttttgtccttcattataaaaatgatatagtatagaaagctgaggcccggagatgggtcaagagagttggtggctgtgccagaagcagactcctgaactgtggtccctttccactctgtcctcagttttctcagcaggtattattttataattggggcagtgaaacacataaacatacaacaaaagagcattctagttttgacctaagttacaaaggaaattgaaagaaaatatttatagttatatctttaaaaataacaaagaatcctggccccatgtttgaaggaggcaaacttcctggctgagttcttggaatcaggaaaaatgatcacacctcctttgtacctcaggctctgtgcctcaaacctatagaatagagcctgttttttttttccttataaatataaaactattattgctagaggatagacatgggaaacaaaaatggaatagacttgaactgcctttttttttttaagattttatttatttgttcatgagagacacagagagagtggcagggaaatagagggagaagcaggctccctgcagggagcccaacgtgggactcaatccccttctggggattgaggatcacaccctgagccgaaggcagatgctcaatcactgagccacccaggcaacctaagctgcttcttttttaaaaggtgacataatctaaaaggaatgaacgtgaatttaagagttatcctttaaggtatacgcagaatgttaatagtgttgggactgagtatgagagactttctatgtggggttacctatctctataccatttgaaccttgcaagaagcatagattgtacataaaaatggggggggggggacatttgaaatcaaatatagccaataccctctctaaataaaataacaggtgctcattatagaaaatacagaaatatataaaacaaaaatttttaaatcaactattttttattttatttttttaatattttatttatttattcatgagagacagagggagaggcagagacataggcagagggagaaggaggcccctcatagggagcccaatgcggaactcgattcctgaaccccgggatcatgccctgagccaaagatggatactcaaccactgagccacccaggtgtccctaaaacgacagttttaatgacctccaattttatcccttcagagagagccccactttaatatgttgatatgatgccttcaatcccctaacttaggatcattctggatatagtcctttccaagatttattatgagaattttcaagcagatagtaaagctaaaagaattgttcagtgaccactcatacccaccccatagatcctcccactaacattgtactccagttgctttattgcagttacccaactggtcacagataactttttatttttttattatttttttaaaagatttattaatttattcatgaaagacacagactgagagagagaggcagagacacaggcagagggagaagcaggctccatacagggagcccaatgtgggacctgattccagatcctgggatcacagccagagccaaggcaggcgcccaactgctgagccacacaggcatccccacagatagctttttaaactatcatacactcatagtaacctcttttggtttagtggtgtgcagttctatgaatgttatatgtataggcatgtgtaaccaccacaatcaggattcagaacagttccatcatccccaagtaattccctcttaaaaaaaaaataaattaagagaggaagagagagaaaaaaagagagggagggagggagggagagagagagagagagagagagagagaaggggcagagggagagggagaaagagaatcttaagcaggctccatgcccagcatggaactcaatgcagggctcaatctcacaaccctgagatcatgacctgagccaaaaccaagagtcagatgcttaactgactgagccacccaggtgcccctcacatgagtccctcctgccctccccttgtaggtatgccttctccccccacccctaagccctgggaaccactgctctattctcagcaccattgttttgtatcttctagaacgccacagacattgaaccatagagcatgtatcctttgagactggctttttgcagtcacattatgtgtagcaagagtttgtcccttggggatccctggatggctcagtggtttggcgcctgccttcagcccggggcataatcctggaggccccgggatcaagtcccgcatcaggctccctgtgtggagcctgattcttcctctgtctgtgtctctgcctctctctctctgtgtgtgtctctcatgaataaataaataaaatcttaaaaaaaaagagtttgttccttaggaggcacttaaatatatgaagccaatctttacagacataaagggagaaatagacagtagggatccctgggtggcgcagtggtttggcgcctgcctttggcccagggcgtgatcctggagacccgggatcgaatcccacgtcaggctcccggtgcatggagcctgcttctccctctgcctatgtctctgcctctctctctctctctctgtgactatcataaataaataaataaaaattaaaaaaaaaaagaaatagacagtaatacaataatagtagaggacgttaacactccacttacatcaatgaatagatcatccagacagaaaatcaataaggaaatattggctttaaaagacacattagaccagatggacttgatagatttatatagaacttccatcaaaagcaacagaatacatattcttctcaagtgcacatggaaccttctccaggacacattaggccacaaacaagtctcaggaaattcaagtagatgaaaattatatcaagtatcttttccaaccacaaggctatgaaactagaaccagttacaagaaaactgggaaaaaaaccacatatacactaagactaaaaaacatgccactaaacaaccaatgggtcaactaagaaatcgaagaagaaatttaaaaatacctggagacaaataaaaatggaaacaactttccaaaatgcagcaaaagcagttttgagagggaagttcatagcaattcaggactacctcaaaaaataaaattctcaaacaatctaactttacacctaaaaaaagaacaaacaaagccccaaattaccagaaggaaggaaataataaagaccagagcagaaataaatgaaatggagacaaaagcaaaaagaaaaaacaaaacaaaagaatgacatgcacacacacaatagaaaagatcagtgaagggtatctgggtggttcagttaagtgtctgactcatggtttcagctcaggtcatgatctcagggttttgagatccagccttgcattgggcttcaagcttagcacagagtctgcttgagtttctctctctccctctccctctgcccctccctcattctctcaactgtctctcaaataaaaactttacaaaaagagagatcaatgaacctaaaagctggtttttggaaaagacagacaaaattaataaacccctaaccagacttattaaggaaaaaaaaaagaggggaagggtgtccagctggctcagtcagtggaatgtgtgactcttgatcttagggttgtgagttcgggccccacattgggtgtagattactaaaaaataaaatcttaggggctcctgggtggctcagccatttaagcgactaacttttgctttgggctccagtcatgatctcaggatcatgaatgaaactgagcccagtgttgggctctgcactgtgtgtagagcctgcttaacattctctctctccatctgttcccgtcctgtgctcatgctctcacttgctctttctaaaaaaacaaaatgagggatccctgggtggcgcagcggtttagcgcctgcctttggcccagggcgcgatcctggagacccgggatcaaatcccacgtcgggctcccggtgcatggagcctgcttctccctctgcctgtgtttctgcctctctctctctctcactgtgtgcctatcataaataaattaaattaaattaaaatttaaaaaatgaaataaaaataaactcaaatggactaaaacttgaatgtaagaccccaaatcataaaaatcctagatgaaaacataggcagtaagcaatctgacattaattttagcaattttttttttttttttgaccagtctccttaggcaaggacaactaaggctaaaataaacaaatgggatcacattaaaatgaaaagctttttcacagtaaaggaaatcatcaacaaaatgaaaaggcaggaatccctgggtggctcagcggtttggcgcctgcctttggcccagggcacaatcctggagtcccgggatcgagtcccgcatagggctatatctatcatgaataaataaataaaatctttcaaaaaaattgaaaaggcaacctactgaatgggagaagatatttgcaaatcatacattcaataagaggttaacattcaaaatacattaagaaaaaaaaagagaaaaaaaatacattaagaactcatacaacttaatatttaaaaaaacaaacaattcaaaatgggcaggaggcatggctagacacttttcttctttcctttttcttttttaagattttatttatttattcatgagagacgcagagagagagaggcagagacacaggcagagggagaagcaggctccatgcagggagccggacacggacttaatccctggtctccaggatcacgccctgaactcaaggcggcgctaaatcgctgagccaccttgggctgccttcttttttctttttaaagattttatttatctattcatgagagacagagagagagagagagaggcagagatataggcagagggagaagcaggctcctcgcagggagcctgatgtggaacttgatctcaggaccccaggatcatgacctgagcactcaatcactgagcactcactgatcatgacctgagcactcaatcactgagcactcaatcactgagccactcaggtgccctagctagacatttttttctagagaagacatacagatggccagcaggaaccagaagaaatgctcatcactcatcatcagggaaatgcaaatcaaaaccaaactgagggtatccctgggtgcgtcaaaggcttagtgcctgccttcagcccagggcttgatcctagatcctagagtcccggatcgagtcccacaacaggctcccggcatggagcctgcttctccctcctcctgtgtctctgcctctctctctctctctctctctgtgtctctcatgaataaataaaattaaaacacacacacacacacacacacacacacaaaataacacaaaaaactgagatctcacctcctacctgtcagattggctgttatcacaaagacaataagttacaagtgttagtgaggatgttgtgtgctgttgttgggaatgtaaattggtgcagtcactatggaaaacagtgtagaagttcctcaaaaaatgaaaatgaaaatatcaacttgaagagatgtatgctccctatattcactgaagctttatttacaatcaccaagatatggaagcaacctgtgtccatcgataaatgagtggataaagatgttgtatatgtgtgtatatatatatatatacacatacatacatacatgcaatggaatattactcagccataaaaaggagatcttgccatttgtggcaacatggcatgataatacttagagaaaaatcctatgtgatttcacttatatgtggaatctaaaaaaacaaaacaaatgaacaaaacagttacaagaaacaaattgttgcttacctgactggggaggggtgggaggatggacaaagtaggtggaggagtttaagaggtacaaacttccagttataaaataaataagtcatggggatataatgtacaacatagggaatatagtccaatgataataattttgtatgttgatagtaactagacttatcagggcgatcatttcataatatataaaaatactaaatcagggatccctgggtggcgcagcggtttggcacctgcctttggcccagggcacgatcctggagactcgggatcgaatcccacatcgggctcccggtgcatggagcctgcttctccctctgcctgtgtctttgcctctctctctctctctctctctctctccgtgactatcataaattaaaaaaataaaaaaataaaaaaaaatactgaatcactatgatgtacacctgatactgaatgatattgtatgttggttatggaagaaggaaggaaggaagcaaggaaggaagcaaggaaagaaggaagggttttgttcatttttactgctaaatagtattacataaatgaaccacagttcatttacccactcccccagtttgggttgggttgcttccagctttgggtgattctgaacaaagctgctaccaacattcttgtacagctgtttgtgtgaatgtaagttttcatttctctaaggtaatatccaggagtgggattgctgggtcatggcagttttaatttgcacttagccagtggctaatggtgtggagcatctctgcatgtgcttatttgccatctgtaaatcctcttgaagtgtctgtagctcttttgctcatttaaaattcatcatttttctttttttaaattttaaggtttttttttttttttttttaattcatgagaggcacagagagggagagagagagaggcagagacacaggcagagggagaagcaggctccatgcagggagcccgacgtgggactcgatcctgggactccaggattgcgccctgggccgaaggcaggcgccaaaccgctgagccacccagggattccctcctctgtttatttagatcttggtttcttttattactgttttggagttttcagcatagacaacctgtgtatgttagatttatacccaagtgtttctttttttccttctttctttttggaaatattataatagtattgcctttttaatttgttttcaagcgttgactgagagcataaagaaataggattgatttttgtgtgttaatcttgccttgcagccataatgaactcagttactacttgtaagagttctagaaaactttctttaaaaaagattttattttggaggcgcctggggcgcctgagctgaaggcagctggttaagcatctgcctttggctcaggtcatgatcctggggtcctgggatagggccccgcatctggctctctgctcagtgaggagcctgctgctccctctccctctgcctactgcctcaccctgctgtgctcatgttctttctgtctcacaaatcttaaaaaaataaaataaaataaaatattttattttatttttaaataatctctacacctagtgtggggctcaaattcacaaccctgagatcaagagtcacatgcttgggcagccctggtggctcagtggtttagtgccacctgcagcccaggctgtgatcctggagacctgggatcgagtcccacgtcaggctccctgcatggagcctgcttctccctctgcctgtgtctctgctcctctctctgtgtctctcataaataagtaaataaaatcttaaaaaaaaaaaaaaaagagtcacatgctcttgtgactgagctggccaggtgcctcgagttctagaaatcttgagcacttctgatggcatttactctctttgaaaaaatatattgctataaaaaattccatgggggatccctgggtggctcagaggtttggcacctgcctttggcccagggcgtgatcctggagtcccgggatcgagtcctgcatctggcttccggcatggagcctgcttctccctcctcttgtgtctctgcctctctctctctctctctatcaagaaagaaagaaagaaagaagaaagaaagaaagaaagaaagaaagaaagaaagaaagaaagaaagaaagaaagaaagaaagaaatcttaaaaaaaaaaaattccatgattcttccctctttatgttagcaattccctcctgttggatattcacattgttttcttttattactattactataattattagtgatggaatgaatttgattctgggacataaatctctgacctcttctctgtgagaaaggattcctagaaatgggattagcaggtcaagggctgggccctccttaagtactacacatggctcagctgctttccaaaaaggtccaactaactcattcccaacagctacatgtgagagcactcagcgtgctgaaacgttgccagcactgggaattatcattttaaagcgttttgccatttgataggagaaagacagtatttcccttgcattttaaagtaatcccttctaaaatgccaacttgtcccacccctgctaaaaaccttctatgcctccctattacttttggaaaaaagcccatggcccagctataggtaggcaccccaatattagctcccatttactccattgtcaaattctgtggcttccttttcctaccctgtactcacactacagcatggctggttatttctgaaacccactacaaaagctccttccctccaaggctctgcccatactatcccttctgcccagaatgcaggtgttttcctcctgttggcccctcaccaaggtacacaagagaggttttagagtgttggttctggagccagactgaccatgttccaacccagctctgccctgcggccttgggaaagttattcagcctctctgtgcctgcattactgcaatggtgaagtggtaggaagaatagcagccacttagggggttgttataaggattacatgagttaaaaagagtatatcagaactgtgtctggcactttgaaagtattagtacatcttagctattcctattattactgttattcatgtctgcccacccctactcttggaaggagggagcaggatggcaaaaccactaattccctgggtgccgagcactgtgctgccccattcagggcacaccctgcagcctagcaggacatggaacacaacccaagggattcaagaggctttaatggaagggcactggtggagggaagaggaacagtgtggtgggggagtgggggggtagcacccacacctgcaatgtgcaatggcaggaagtcattgtgactcccagggctgaaagggcaaggggcagaggtaccgggagcttgaagatgcaaggggattcatggaaggacacagcccagccagaccaggggccaaagcagggctggggccagggcaggagtatgccgacttctccttccctcagatgccctttgagtgggtgctgcccgacagagagccagctggcaagggggcccgggcacagagccagtcagggcagggatggatggggaggtaagggcggggatgcaagcacagggggatgtgttactgtccaccacacctcccatcttgcaggtgaccagactgaggcccgagacaggaagaaacttggccactgttacagagtaggtgaggtggggctgggagaagaccgcaggctcagaggcaccgtccctcgtcctaggtccctggtccccgcgcgcggtgccagcagcatgcagggcggcggcagcgcccaggccccctgcctccctcctctcctcgctgcctcccactggtcacttgtcccttcctcgggctcgggctcgggctcgtctgccatggcctgcgtgaaggctgcggctctcccctcctgggtctcgtatcctgctccgctttagctctttctcctcccagtgtcagcttctgggccccggcgttcggtcttggcactcctctcggcctttctctcccacacggctggcttgccgcggccccctcagctcctctgctctcgcctggcctgtccccggtgccgctccgtcccccggccccgccgcgagcgctcggtgcccgcacgccccgcccctgcggctcggtggcagggcccgggggcggggacagcgggctggcgcggcgcccggcctgagtcacacgcatgaggcagcgtgagtcaggcgcggagggaagtccctacggaaggggctttcggagccgcaatcgaatcacagggaaagagaaagtgttcggccgttcctctgacacagtgaccttgtgtgcgccgagccgggcacacccccaacaccctacccgcggacaacgacacgcgcggcccggccccccacccctgggtgcgcggccggggtcccagcggggggtgccgagcgctgtctcccaccccacccccgccccctcctccacgccagggcccggggccgcgcaccgtctgttccctgcgcctccggcgggcagtccctccagcttcccaagggccgggccagcattgctcagcagcagccacctcacactcgtcccccgtacccggtgcaggcagggtgtcaggaaggaccccgtccaggtcggccggcttgcctcgtggggccccgctgtgtggcaggagaagatgggccctggggatgaaggatcctccctcaggctctctgcccaaccctctcagattggccaggaatcaggttggctggattaaattgaacaaattttttattgaacacctataataaaatccagtgccagaccttaaaaacttaggataggaccaaaaaggccatgaacaaaatatgttgactcccaccctccgtgagcagatattgggggcagacaataaataataagcaaagaatctagatcagcactgtccatggaaatagaaggcgaggcatttggtaaaaaagaaataaatgaaataaactttgaaaatatacttcatttaagccaatatgcccaaatattatcatatcaacacaaaaatcaatatataaaaacttagtatttctttgtgggtttttttttttgatagtctgggaaatccaaagtacttcacatttccagcacatctcaattcagactccccacatttcaggtgctcagttgctacctgtgtgtggtggctacagtaatgggtagcacagtctagatgtgaggtcaggactatggaataaaaaaagtagcgcagggtaaggggcggggcaggattcagagcactgagacctggagatagactgaatcccagtcacctgacctcgctaaaccccaatttcctcatctacaaaatggagagaccaatcctcccctgtggatgagagtaatgagcactcattaaatgttattttgatccccacccctccagctgtctgtattagccgccagcgcacaggctcccagtctcagtcacatccctccacccccaacacttaatggccgccaaaaggcggcctagctgcccaccgggcagtccctccaccttgcatctattcctaccccttgctacagcaagataccctctttagaccttgctctcactgtaagatggatacttaagagctcctgagaaaaagtattgtagatttctggggaccaagccacggtttaagctggacccaggccaatgccaaggtaggtgggggtaccaggtgccaacttcatcatactgggaaggtgaaatccctttttgagaactcatagaagaatttctgcccgcaaaagacatcctgctccccaaacctcctcccaccaagggcagaactgccagaaaaagagatgcagagttgctgagagcagagcccaggagcagggattgaggagagagggccccaagcctaggggttgccatggcaggggttcttgagcacctttatccactctaccttcaaggtagataggccagcagaactacaagcccaagggaagttccaggatcaacaattagccccttcctgggggcctccatggctcaggaggaggccccagcaaggctggaagtgggggatgggagcaggcccagaagtggcccagacaaagaaggcagccgggtctgggcttcggatgcagctggccctcacccctcaccccaccccacccccaaagcccaagaattggcagggcaccctggatggtgacccagaaacctggctgtcagcagctcctgcctggcactgcccacggggagctccactgcttcccgcaggggtctctggcagctgtcagtggggcaagcccttggattttctctgcccactggctcactcctctacccctagagatccatcccagactctgcaaggtggcccagatcccactctctgtatttcctgtcatccagacctcagagtggggaaaggggaggggggagtccaaacctaggtttaccatcagactaacactgcccaccagggccattcagctactctggtcctggaggaccaccaacgccctagtggctgggttcctagaaagtaagaaagtaagaagacaaagaagggcgctgctcgattggcagtgaagagctgggcctagttggacctacgaccctaggactcgtagggtgggagggaggcggggaggctgggtgagcagggggtaacgaggtctaagccagagtggtgggcaggggagccggccaggcccgtccccgccgccatctcctagccagattccagaccagcaggctcgccctgctccgcctgcctccctcctcctcctcctccgccctcccgccagtggctacctcccctcccccagcccgcttctctcccctcccccagcttacccacttcctctgcccctcccccagcccttttggctctcattcatccatccattcaccaacttcagctgagcgccaaggcccccttaggccctggtgcgaggctcgcgggtggggagaagaacaaaacaaagccctggaggattccgacaaatccctggcctggtgttggctcctcccctcacccccagcccacctcctcctcaactagggcccccgcccttcgacctccaccctgctctcctttctatccgcagactctggccggccccaggccgtgagcccagcccaggcatcccacgtgctactgggctctactgggctccggcaggctgcaggcagcacgccctccagcccatccccggcatggagaccccagagccacgctgtcagccccaagaaaggtgcagggtggcctggagcagacagagcactggggaacccaggagacaccccaagtggagcagccctccgctgcagaggcagaaggacccagctgggccccaccccaccccagacaagtgggtaggagggagcctccccacaacttgtgaaggatagtcactcttgaaggcttcaggggtcactattccccttcctcagacccagcacttagggaagagagcaagagaaacaagttaaagaccacaggagattctcctgaatgcttggggcatgttcccaaaagagtgtgagggaggtaggagcaggtggctaaagctacaggacttgggaggcctgggtggctcgccggttgagctacctttggctcaggggctgatcagggatagagtctcgcatcgggctccttgcatggagcctgcttctcctccgtctgcctgtgtctctgcctctttcagtgtctcgtgaataaataaaatcttaaagaataaaaataaagctacaggacttgagtccccaagaactagagctggttattgaactgactggacatccaaccccagagggcatgtggtctggggagaaacccagcccagtgcctcaagccggactccagaattacacttcagcccccagagaacagggtcccaggccctaatacttccttccacttgctcgcaaggatggggctttcacagactacgtagttttcaagtgtgtgtattttcagccgttcctgaaacggctgggcattgtacctgcagagcctgttgcactggacattgtcaggtagttccttggagcaaagggacacctgttctgtgcaaagcttaaatcttacactcactcaaagcacactctggagagctgccaccaccgcccagccaccaataagcaaagcaacccggctggtccactctggccaaagggccaagatggttgccaggtggcggccagctcctgatgactaaacctgagaccaaagggaaaaaatttcccctgattgctggcaaactgtaagatctagaagtagtgcctgctagaaattagtctgcagatgacaatggtacagtgactttaacatagacagaaagcaggtgtttctgtagggtgtagaagctgcatcttgggctaggccatcttgtgactcccatgatgatatgctgggttcctcacccttttgtctgccttgaggtttggggacagatggcctttgcccaacccaatgccctgtgggttggcttttgtgataacggaaatcacttctgctaaacattcttcattcaacagttgttttagatttgaacactgtgtgagaccctgggaatccgcctgtcaataccacacatcaaatcctctggccttccaatggacactgttggacaggaaacaaatgtaccacttttaccgattacaattaagtacaaagttagttatatagtacgttagcaactgataagtgttatggggggagaagcgtggtaaagtagatgaagaattgcagggcaaatgtgcaattttacatagcatggacagtaatattgaacagagacctgaaggtggtgacagggtgagtcctgagaatatttataggaatagcaggtcaagcagagggaatggcaagtgcaacaaaggccctgaggtgagctctcacctggcaggtgtggggaccatggaggaagctggtgcagctgaagtagaatggcaggtaggtgatggggttaggggtggggagattgctgagctttggggtttgggtgaagacttcatttttaccctgtgagatgagaatctatgaaggattctgaacagaggtgggacatgccttatgttttaggtggaaagagatttaataccaggaattaggtgctcttaaaacttttggaagaactgaggagccagctctaggctgggcctcctgggaaaacacaactgaactgcctccctctgctctgatgggggtgggaatccagaggccctcccatctgagtagctgacctgccatccaggaataggaggccctttcttgccgtccccgcatacctggctcttgatccccataaagctggaaactggatgttatatggattccagaaagcccaagtctccacagcccacacagtggtatttccctctctctgcttccttcaaattttcctctttctttggtgggatctaattcacatcctaaactgtgtggggaatggtgctgagtccagctcctatgtgtgtcacagcccggagcccatccccacatcagatgccctgctgcctcacctgcccactcccaggccttcctgtgatgctccacccacacactgggcccctgccttgtgcttcctcgggcccccattccagcaggtaccacactgttcaaagtatatttgccatgtacttgtctgccccccatcccacccaaagtacaccacttaaagacagggaatgtagctacctggttcaaggccacatcccttatgcctctcttggtgcctagagagagccatctggccaggctgggagaaggcagcaacgccacccagcctgggcatagaagcagaatgtcaagctgtttaatcttcctgagcctcagttttagcacctgtataatggcggcaacagcatcactgatctggtaggagtgttgaaggatctgagaacacatttgcatttagtccatgctcataaactccttttcctcattttttttctgaggctgctgaggagtggggcttacctgtgtttcagccttgaagaaagctgacaaagtccatggtgccctgcagccatgcagcatgggtaattggctcagggcacgggggtgcctgtctcctgggccttccaattcgttgaagagattttccctcgaaagttggaagcagaagaggctctcctcccattctaggcctgccaggcctcctggcagcagagcttgtggtcagcagggcctggagacctgatcctgccagatgaccagatgtactagtagctgggtgactctccaggagtggtcaaacactgtacaccagggcgcccctatatgtgacatgcgtgggtcaatcctggtgatacagccggggatcaatcccagttttatgctgtctggtcaaaattaccgcgaagtccccccttttactcttaagtggcctacttgcttgtaatagctggacaaacctatcctacaatccaagaattcctttcctaggcactacttagcagaaatttgcacatctaatcacaaagacatattctggaacacccacagtagtactatttgtaataacccaaaccagagtccatccaaatgcccttcaacagaacagatacataaactgtggcacattcacaccatataactatgcagcaagaagaatgaatgtcagccgcatgctaccacatggatgaaactcagatataatgttgaacaaacccaggagtgtatcacctatgattccatccacgcgatgcatgcaaaaggggaaagtacaggaggctattagaagtggcaatggtggtgacgtggtggggctggagatggtttctggatctgggtgctggtgacacagggtgttccttctacaaaaatgcattgagctgatacagggttgtgcattttctgcacatacagttttcatcagtaaaatgtttactttaaaaagtatcccagtttgggcaatggttaaactattctggtttctcttcttcctgcctcctcccactaccttttatgttgggctggacatacaatgttaatcaaacctcatcccccgggcttctagaaaacctcaactaacccaaacactacatggaaccattgacagtggtcttctcctctactcttccaagagctagccgtagatgactcagaagaggtattgagaagcgcatatgctgactggagagatgtactgagacatgaatccccagggaaagctaagagacactccaacccactacaacctctgcatttccaaacttcgactgggattgtcagtctcccgctacaccacttggcaaggcaggggacgaactggcatccatcaggaggaattgcaacagctcaggtgaaaatgaacttaacctgcagctgtcctgaaatacagagttgatcggaactcctcactccgtggacattcctgttgggttcctgaagttggctggttgtccttgtggaaactgcataacccaactctgacagtaagaaaatgtttcctaaggggaagaccagttctgacatgatggattcccctgggactcctcaggccttgaccaaccaggttgatgccccaggcttagaatagctctttcttgctgctcctaattccctagttatccaaatgccatcaagaccagctcaaggcctacttcagcccagctcctccagccaacttacttccctgactattctgagctcccatcttctctccctctgtagcatgagtctctgtttaaaggcctgactccctagacataagcttcaagagcacagggaattttactttgttcactgcttgtaccccaagagtttggaccagctcttagtacctagtaggctttcaataaatactgactgaatcaaagagtgcacctggcctcatggcatctcctgggttgctcctcagctttctctggtgtgttcttggttctgattcctctaaatatgaaacttgctggagcaagaaccatatcttattcatctttttctcacgaccactcacccttctgcttaatacttactgaaaaaggaaggacagaaaaggaagggaattcagggcatctttaatccagaaggcaaggaggtcagtggtagttctgcggattgcaggggcgaggggaatcctgaagaggagcaagctatcgtatttgcccccaagtgtatttatacctgcctccttccagggagggtttgaggtggctgacaagaacacccgcaggacaaggtaaaaaaccaagtcggtgagaaaatcaggacgaggggaaaaataagggtaggaaaaataagatcaagtcggctagttagaagtgggccaaaaagttggccaagttttcccacagcccctggaggcagaagtccctctcccttccccaggtccctcagggaaggccgcaggacaccggccaagcgcgcaaggcagggctgccccaggtaagctgcgtcccggggaggggcctcccaggccgtgggccccggagctcggcctggcgcccggcgtctaggggcgcgcgcgcttctgcgagggccacccccgggccaggcgcggggcccgcgtcgccggcggggaaccgtgacctgacggtagtggggcaagaactgaaggctcgttcttccgctcaacgctgcagaggttctcgagccacctcaaggcgtccagccaacccaagtcgcggcctactaagcgcgcgctccgcacgcagggcacaaagatggagggagccgcgcgccttccaccccgccccgcccccaccccggctccaaacaaaggggcaggccgcccctcccccagcctctcccaggccttcccctccaccctcctctcccctccggtgacttcctttcccctccaggggcggcctgggcacttcgcaggaactccgtttcacctgggcgcggggagccggcgcgcgcagggcggcctcccggcccaccccgagccctggcggccccaggcccgcgcgccctcctggctgaacccgcgcccggggccgccggcgccttcccgcccgggcgcccccgcccccgcccccacccggccgagcacgtgctgcccccggccccgagcgccggcccgccgccccgggtgggggctgggcccatcccgcgctgctccccacccccaccggaaacattcctgaaacattcctgaaagtaggaggcccggcccctccggctccccaccccgcctccactgcgggcgcagggttttcctggcggccccctccttcgcccgctcgccccctgaggagggggctgggctagggcctcggccggccggggaggaaggaggggagcaaagaacaagatgagtcacagccgtggtcactgggccgcattgcatttccctgcatcacgggaggtgtggagggcagccgcggggaccaggggcgggaggtgcgcccgaggaggcccggacccggcctgcagggcgcgccgctctcgacagcgccctttcttctcccaccgccctccccgccatctttcgactttggcttcctcctcgtcggtgcaacaagtctctgtggcgccgggcgggccaggcgtggcggggacggctcgcgtcgacccagtccctgccctcaaagtgcttccaggcgaccgtgggctcacgctttctcgttctccttcgcagcggagaaggctagggcacccagtgggtaggcgtatctccaagcaccacgcgagccccctggagggacgagtccaccctcgggtttacctgcaagcgagccaatcgtttgcttcgcttggaggctgcacctggatgacgtctcactcgcggccattaataagcgagaactcgggatttcacaagtttcacgtttggatttcacaagacttgtatttcaaccagtcagccacacgcaggttggcactgaaatgcacatgctgacacctgtccgcccaggggaatctgcgagccgcgattctgggcgctggggcggcggtaggccgcgaattctcccgggcgcgttcctccccgcccccgcccgcccgcgcggatcccgcgggcactaacgcccgcccacacccagcgcgccccgcgggcgccgggcccacgcgcccggaaggtccctggaggtgatcctcccaggaccgcccccccgccccgttccaggctgtgaggacgccctcccctctccccccgcggaaagctccttggcgttcccactctatgcaccctccccgggctcccggcccgggacagtagaggggatcgtggcctcgggttcccagcccaggcctcccgcgcacccctcccgggcgtcagcacccacccgcgcggcggcggcggctggcgggcggccgcccttttaaatccccgggctcatttgcatggccccgccccccacagtgacacggctggcgcgggcgggcccgtcccccctgcccctgggtcgctctttttaagctcccctgagccggggctgcgctcctctaattgggactccgagcccgggctatttctggcgctggcgcggctccaagaaggcgtgagttcgcggcccctccggtggcttctttttttttttatgtatctatcatttaattaaattatttatttattgaggccgcgcacgggccgtgcctagcttcctgcccctcgccatccttcgggggagggcgaataattttgtccccccgcctgaatgtgacagataaataccccaagggggcctgggcggcgagcacgcggcggcggcggtctctgaggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatgcttagaaagccatcttaaaatctcacttcattcagaaagcatattttttcctcagaatgggcgcatcaaagtggtgagtgtgaattgaacacccggcggagcccggtgcacctcgcgcggccgccgctcccgctggagcccgagcccgagcccgagccaggaccccggctgtggggggtggggagaggagcgggctgcggcgaggcgggcgagtggggggccgggcgacccccgcagcccggggaagttctagaagtgagggggatgggcgggagccccgcaattcagctctgctcccgctcggccttcctcctggtgcccccctacgcagaggaggccgaaccgcgcggccctgggtttggggcttcaccccgaccccacctctggcccggcccgcgcctcttcagcccccggggccgggcctgccctccgcccccacaaacaggtttctctgctttgcagggctctgttggaactagtccctctgactccccgtttcaattttttttttttttttctggagctttattttgcggggagggcgcggagggaggtggctttcttcctctaccccgcgcccgcgcgcgccaggtttcctgccccaaggcgggcttgggtgccccctctggcaggaagtggggccgggtgcacccgcgtggcggtgcatgcggtcggggtgcaccagtttcccgcgcctgcgagagcagcccgtgcccctccccccgcgcgctcgggcccctagtttcgttggctgacctgcaacggcccggcccagacacttgcagagtcaccctggggccgggtctggagcagggggcgacagagactttaatcagtctccaggagggtaaggaaagaaaagtcccgggctagaggggtcgccggtaacaacctctctttcctcaccaacttgctgtgtgaccttgggcaactcctcaggcctctctgggctactttttttccggaaaacaagggagccccatgatgatttcctagggttgtgctcgtagactcgtgtgcatttgtggaagacccattgcatgcacggtgtgtggaggggcaagcttgaggcccagaaaggctcattacatacagaaggattcaggttgggccctaaacatggcttcgccagccaggcttctgatattcagaaacaggtggaagaagagacaagccctaccgagagagggcttcaggccttcattcagttcctggaggcctggaaggggagggagttggagagtggattaaaggggtccccaggagtatgaggtggtggggggatctccagatgatgcaggaactttcccggagacccaccaggattctcaggcatgctgggcccaggctttctgggattaggggctggcttggcccaactggaaccccctccgtgagggggccttctgcagacctcatgtgaggtcagtgctcatttagactgattaattttgatgtttagcttgaaggggaacctgtggtgtaatataagattctaatcactgcctgtaattacagagcaggccaagccactaatgacggagcaggataaatcaccaaccaccttgtttaaaagggtcttcaagtctgaaatattataaaatagaataattaccaaagtctcaccgtctggagaatcgtgatgcttgaggatgggggcctcaagccctccaaaaatcacaagtttgcaaaaaaactttcttttctcttggctaagttaaaattggaaatgtgtctgaaaatctgaaataggtgaaagaaaagtcattttcgaatattctagttctcattttgattgaagtgaggactttatgttgacgcatttaactatgatcttgactatgatgatcatttaactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccgtgtttaaacaacttctcctgctccctagcatcccagctttcgctcctccacctgctccagagagaagggaagatgagctagtcgagctcgaagtccagccagcctttggcctccaagcaggaaaaggacggcactgagaagcgagggcggggccggccgcgcaagcagcctccggtgagtcccgggacggcgctggtagggagtcaggtgggtgtccaaacctttgctcggtttaccccctttgggttagggaggtgccacgtgtctgagcaagtgacagctggagtagagggctgcagaatccatgctgcatgtcggtgtgcgctcactccaaacatgcaccccacacatgccaaccctggtcagctcctgagaccccaggagagaagtgggggctgagaaattttttttttttggggggggggggctgagaaatttgagtgacccctgagcccatgccagataatccaagccagaagtgacctcatgctcacatcctggtaaactacccaccctttatgtccaggctgttgtggatagaccagcatgtttacaaaaacacagtaaagaggagtttacatatatgtctaagtcctgtgttcctaatccttaggctcacaaaagatacttgtctgtccattagccataaaagttactaaatacttaactgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggactatagttccaacagcctgtgggcagctaccccgaaaccgtagctgacctgcctttactgtccagcttctgtgcattatgcagcagctttttattccgtcaggcttagtcaggcttagtaaatttcaccggcgactacggcagggatctcttggtttctgacatccgggcctgatttccctccctgggacaaagcctggagggagtttggtttgcaggtagtggttggaggctccctctggttggggggtgtttatcctcttctgcattcccccaggggctggggcgtggtattggcccagtgggggacacttctgcacccttccttgaggctctgatgctctgtgagggaagtcttctcaccatttgcagttgaggagactgagtcccaagcattctgggtcttgcctgagagcttagggcccattggtggcagagctgccggatgggtttttctgccctatgacccctttcccttttctagtttcttgtcattttgttgtcacagggaagcacgggaggggctttgcaaaatagagcgagaacttgggtctggagggcttgcctgctgtggtgcctgtggatttctgggtcagggtgatggctggctgacttggggtggaggggagagctgtgtctcgaaaggggtggggcagatggcatctgtgtccgattatcccacctgcctttgcagaaggaacccagtgaagtgccaacacctaagagacctcggggccgaccaaaggggagcaaaaacaagggtgctgccaagacccgggtaaggatgaaggaggcacgggtggcagtgggtcttggcaaactggggacagcagggcaatgactgactcctcactggtgggcactcaggcctgcacaggacgatggggaaatccagttagaagccccatagctctccttgtctggagaaaggtgaatggggaagagtgaaggggtagttccatcactccctaggctgaccatgttccgttccattccggggtcccctgaatccccagagaaatggggccaagcagggtaggccagatttacagtggcatcagtctctcagagaagttgttttgttttttattttattttttctgagacacgactcatatcctctgagtcatgggtggaggagggagtggggggcgtgtgtgtatattggggggggggtgcagtgtggctagccagtcatcaccagctggcttcgggtgggcccgcaggctgagggagtcccaggctgccctgagcagaggtaggtggttcggtccctccccatcctggtggggcactgggcatccggtgagcagtggtagggatgtttttcaacttagtggatctttttctctgaccatctagaaaactaccacaactccagggaggaaaccgaggggcagacccaaaaaactggtaggtgaagggatggcggcggtttcttacttcctgggagggggtttaagaatgggtgacagattagtcctgcgtgctctgcctgggaagatggctttgcccaacctgagccaggaatcctagtgggacatcatcattctttctacccaggcctggagagggagaggatgtgcgtgtggccgagggtcctggcacccagcccacggcttttaaagggctgtgtccctgagaagtgaagggtcctggggacaaaccagactctgacccctgccctgccctggtgggttggggctacttctctttcctctactcctagaacagactccatttctagggggaacttggaggtcatctagtctcccacccccgggccccattatagaaatgaggaaagaagactatgagcatagggtgaggtctgtcctccccacgctcttgggtagcgaaggaagcagcagcaaaggagctcagccctggggcaggtgggtagtgctctgtgggagcagagaggtgatcccactcagcacctcaactgggaccatccgattctgagcccccccccccccccccccaaccccgacagctattaataaaaaaaagaaagccgaaacccagaagctgcttctaaggcccatactgaaattaaagccccccccacccgctctttctgggctttttccacctacccccccccccaatttgaactcaagggcctcattcccccagctgaacccccccccaggtgaagaagggaattaaggggtgcttgccccgcccccggaatgaataacaagaaacaaattgtttttgaatttgtgcccggcaccggggccccaantgaggaggggagttagggggtgctggcccggccccaggagtgtgtaacaggaaacaagttgttttggagtttgtgcctggcacgggggccgcaggcccatgtggtgtcccgacattcccgcccagtgagtgagccccggcggcacacacttccccttcctccccgccctggcccggggtcagtccatggcccatcagctgcctctgcgggccaaggccacctggttccccggcactgcacccagcacaccccgcagccgccccttcccgcttcctctttctggccacctctcccttctcttcctacagagagccactcacttcctcaggctgcagctcagtgccacacggggctctgcgggtcccgccatgtccaccacaggcccgggggccaagggggcctggcctggtgcaagagcagcatgtgtgtggggttttttttttccctccctctaaattcttccttttttatgaatgaaactgggccgtggaggttgctgagtcactcacacactcagccttgactcatcccccttctggagagccagggagcccggggaggggtgggagcgatcctggcctgtgcctgcccctcccactgactgccctgtccacctcacaggagaaggaggaagaagagggcatctcgcaggagtcctccgaagaggagcagtgaccgcgccgtgccgcccgctccttcaccgaggggcagtttccttctgggactggacagctccgctccgctcccaccgcccctgccccttcccccagacccacgcctccccgccacccccctgcgccttcaccaccacactacacagcacaccagccgctgcggggccccaaggcccgagtggggagccgtctcctttggtcttggtttccagtgacccctccacccacacgcacacttgcccttccagacaaggctgacttcccactgcaccgtatgccctgcccctgccgcatcctcctgctcagtggtggggacatcgctgaccgggctcttggctttggggggggaatcccttctgcttcccctttcttcctctggctacccactaaggggcctgggagggctcccctggccttaaaaggggcccaagcgcccatctcattctgatctgccccactccacagcactggcagcagcaggtatggccggtagggaggggcactcggccccaagacgccccccgactgacctgtgtttcattaggtgcggttcacacccacttctcttccttcccactttgcctggtccctgctctgggtcagacagccccctttgggcacaggaaggaaggcaggaggggtttgagccccccttactctaaatgggctccagcccaccttccttcctggaatctgttgcagtgagggaaatgcattccccccctttatccaggtgaggctcaggaggtccacggtccctgtggcagccacctgaggtgggctagagcgcctgcccaaccccatgcgcttccccctcggcctcagtatcccctttccttacatggggcactgataacaaggagctagccttgcccactcccacccttctgctcctccccaccccccaaggttctggttccatcttttcctctgttcacaaactacctctggacagttgtgttgtttttgttcaatgtttccattcttagacatctgtcattgctgctgtgaccagcgccaaatgttcatcctcattgcctcctcctgtcctgcccacatcccctcctccgagactcttaggggaagggccccagggcagagcaggctgggttaccgattaccccagtcccagggaaggtggggctctgcccctaggatgctgcagcagagtgaggggggggggcctgtatagaccgtcaagggtgtaggggccaccttctccccctgttctgctggggaggaggtagtcattatttgtcccagcctggggcccccccatctggtttcctatttgcagttacttgaataaaaaaaatatccttttctggactggagtcttcctctggtgggcacctggggtagttgtgaaaggtgtgtggaagccaaagatctagttgagggggtggcttacccaagggctctgttcagctcaggagaggggaagagaagtattagctccagggaaggtaatttaagcctttcttgggaaaaaaaaaaaaaatacccctagccacaaaacattttatttacaaaatatatatactgaatactatacattaggccctgtcaccgtggaaactcgttcaaagccaggtggtgcccatgagacggtgggtggttggctgcaccctgtcacacagggctgagggccctgtggagggtgggggagtgaggtgctgctggggatgggtggaaagaggagacagttcccagcagggggagctgggtgagtgctagcggagagggaggcagcagactgcaggcccagggcacgccccagatcctatggttctggagagctgggaggggtctggttaggtcttgacatccagtaagggcatccgcttgtgctggtagccactctgccagccatggaccacctgtggggagagatggggccatggggtggagttcctgggcctcagcacaaccatggggataccccactagcccggcccacgtgggggaggggagtatggatgggaacgcagcagctggacctcggctaattatcccggagccccagagtgctcaccttggggtcccccacatcagacagtagctcctgctcagcctcatgtagctcctcagcagggtcgtagctgtacatggggagcaggtgatggcgaagccggtccactctggggagcgggggaggggagctcagcccagggtgggtgtccactcccttcaaacacctgacagccctgtgtctactccccaacgcagtgggacctccagtgggtgccttcaggggcacactagggttctaagaataggagcccaattttataaggggcctctcgtgtaggtaagcccagggtgggcaggaaatcctaacaatggggtgcagggaatttcaggcttgtataaggatagccgaggggcatcttaaccgtgtgtgtagagaacctgatcctacaggaagaagtgtaagcagaatgtaggggaggtaacaataggggcagagacactcaccgctttttcttctggacatacattacctgtaacagagacacacagctgcggaggctgctgagcccacaagtgagcacagcccacaagtgagacacccacctgtacccctccacttgcgtaagagcaggacagctgagaccatgtgtgcaggctggaccagccccgcccccttctgcctcagcagaggtgtgggtgtttatgtgcctatgaggggactccttaccacagccaccaccaccccgaccagggtgatgaggaagaaaggccccagcacgtagcccaccatggagtcactgttggcctgaggggcattgggcactgtagtgttactcatgacctcggcagccggagggctgggtagtcagcatgggcagttgagcctcgggagggcgcctccactgggctccctggggaggaggaagggaggttatcaatttcacccagagtgacagccaagctctggatccctccccaggagctggtgatgtatcaaaacttgggtcgggcactgggaagaggtatcctccaagtcagtgtgctgggtttaaccttacagtgagtgactcactggataccctgaatgtagaagacaccaaggggagacccagagtcctgcccagcccctatccccccaaatcagggtgaggccccagtcaggtgctggccagacatctgcacatctgaaccaagaaaagcttagatacatgatctgggcttctgtagcaacccctccggacactgggctgccagcacctatccactggagcaaaaggaaagatctgacaaaaagcatgagggtcctgcactggggggccgcgggggggtgaggcaggagcatctggaggagcctgcctcagtctcgcccaatccccacactttaggcaataggccctccctaggccgggctggtccctggcgttcctgcagacacacagccgggacagcctctcccctactggtctcgtgccagggtggacacgggtgggcagggctggattgtatctgcgaggtgatgtcacctccctctggtccccacccggggctccgcccaggtccctcccctcttagcctgggctgccaggcggaggtgagagggtcagttcccgtcgagagatgcaaggagatggtccatgggctcctcacgcagaccccaagtccccgaccccgcttcgcctgggtctccactggacggcgaggtatgaactacctgtcccggtgtccgtgggggcagcgagcttgcacagtcgcatgcacaccgtcccatggtcgaggggacatgccgaggtggggcgggtgtcgggccgctccgaggatgcggaccagcatcggcgagtgggaggtcgttcccacggcgctgggcgactcggccgagggagggaggtttgggggttgcgcagagggcccgggcctcccggaatccggccccccgggatgcggccccgcgccggcgctctgcagcccggcccacccgatcgtgccttacctcccgccgccgcagcccggacaggaacgccctcgcctttctcccaggccccggaagagccggcaggcgcgtgatcaaaggacccggggaaatgggcggggcctcagcgccgggacgcagccaatccggtggcggaaggcggacggcccggaggcttctggagcggccaatccggaggcgagggcccaggctgcagggcccaccccccggcggcagggggcagccgagcgccgcgcagcggggggaggagagcgcgcggggtgggggcggggctggggcggcttcccggcgtcccccggggcggagcccggcgagcgcggcccgcgaggcggccgtggtccctgcgtcgggcttcctcgtccttctgggtgcagcccgggtgtcccgccaagcggctcccgagcttaggtcaggcgcgggctgctctcccctgcccggggcccgcaaggactccgcgagtgttcctggtgcccagggtgccctctgcgctgtgctcggaggcacatggaacaggcagcccgggttcgcccctgcctggccgtgggacctggcccgcgcttggcctccagccttttctgcgcctgggtcctaacgtctgccacacgggcccttgtgaggatcacacgatgccccggataaggagtctggcacataccgtgccctgttagatcccccgcgaacctccgtcggttttgacggcgcacgtgcaacagcagggagcagtccccgcccggggtcaccacgtgcaacagcagggtgcagtccccgcccggggtcaccacgtgcaacagcagggtgcagtccccgcccggggtcaccacgtgcaacagcagggtgcagtccccgcccggggtcaccacgtgcaacagcagggtgcagtccccgcccggggtcaccagcaacttgagaagtgggtaaattcggaagctttactggcgcgatcattaatgccacacactggagatggattgatggattcttaccgatgtcagcaccctggctgtgatattctggtatagttgtgcaaagggaagctaggcaaaggatacaagggatctctcttgttcgttctttctttctttcttttctttctttctttctttctttctttctttctttctttctttcagattttatttatttattcattagagacaggcagagacacagcagagggagaagcaggctccacgcagggagccccatgcggggctcgatcctgggaccccaggatcacgacctcagccgaagacagacacttaaccgctgagccacccaggcttcccaactctcttgtttcttccactcgtatgttacctcaagtacgtgtgtagctttgtactacaccttcccaacctctcttcccaatccacacacggttaggaaaactccagctggcagtggatgaaagccacataaaagttgtgggagctgagccaggctgaggccctccagggtccttggatgctactggagatggagggattaactggatccccttattcttgccagagacagccagtggcacggacatggttgagccatttggtctggtctggcctgtttcctcaggcctttccaaagaaggttgatcagggcaagtctgatgcagagatgacccaatctagaaccagagagcagttgggaactctggcctcttgccttcagacaccatcatctgactggtaggaaatcagagataaggggaaaggaatgacagaaatgcttgggtctggaggctccaggtggattccttggtgttctctggcttttgagtctgaagagtaagaagaccactcatcgcaggcttctatcagagctgagggcagagggaggaggccacatccccaggcagggcctgcctcaccttgcaagaggttaggatcaaaagactggttttagaaccccctggctgcccacacacatgacctctgtcctcatccccacagtttctgaccacatatcttgagggccctctaggggtgggcttagaggtcaactggctaagtcagtgtgtagaaaggactggggtctcagcgtcactcagtaaaccccaatttacaaatgagtaagctgaagccctgagcagtgtgtgatgacttcccaaggccctcgtgatcagcaagggtgaagcagaatggaaggacaggtgggtccctcttcctggtcagctttgtgccagtggctgctccatgtctgtatttgaagcctggtttgttcctgtgataaggcttcaaaccccaagagggcaccccccaagcctggccagggaatactccagccctccttgttctcatcatgctgttgcatgaaggaaagggagaaatagggcagagctgaggttgtaccatgccaccctgataaagtttgaactgttccctcacccatgtttctatggttagtgcgtgggcttatgtatcccctttcactaatgccttactcatccttgcatccccctgctctggacctatctaacaaatcataaaagcaacacttgagaagatcaaattgttgacaagtaatgtaaattcattccggaacaaagctcaagaagatgtataggaatgcagctatccagcccccaataaggtaacattcctaatgtgttgcatccactaaaaaaatggattcataaatagacatgcaaagaggcaggaaaacacaatctataatcaactgaaactgacccagaactgaaagatgttagacctaaggagaacactaaaacagttataactatattccttatgcttaacaagttaaggagagacaagaaggatatttaaaagtcccaaattgagtttctttctttctttttttttttttttaaggttttgtttattcatgagagatatggagtgttagagaggcagagacataggcagagggagaagcaggctccccacagggagcctgatgcgggactggatcccgggacgccaggatcacgccctgagccaaaggcagatgcccaagcactgagccacccaggcgtccctccaaattgaatttctaaacatgaaaacttcaatgtctgggacaactgagtgtctcagtggttgagcgtctgccttgggcccagggcgtgatcctggagtcccggctccgagtcccatatcgggctccctgtggggagcctgcttctccctctgccaatgtctctgcctcactctctctctctctctctctctctctgtgtctctcatgaatgaataaatataaaaaaaatcttaaaagaaaacttcaatgtccaagatgaaaaatacaccaaatgagattagtggcagattggattgcagaagaaaagatacgtgtacatgaaggcattagaatagaaatcatcgaaaatgaaaaagagaaaaaagaatctagaataaaattacaagagcatcagtgaattgtgggattcaatttcaagtggcctaatagatgagtaagtagagaggcccagaagaagagagggtgaggtgacaaaaatatttgaagaactaatgactgaaaggtttccaaaagaaatgaagattataaacccacagatctaggaaacgcagtaagccccaagcacaagaaacacgaagaaaactatacgaaggcatattatagtcaaattgcttaaaatgagtaataaagagaaaatcttaaaagatgtaatatacagagaaacaaagtatgacattaaagttccacccaaaataattcatgtaagaagacagtgaagcaatatctttaaaacatcaaaaggaaacctcccggatccctgggtggcgcagcggtttggcgcctgcctttggcccagggtgcgatcctggagacccaggatcgaatcccacgtcgggctcccggtgcatggagcctgcttctccctctgcctatgtctctgcctctctctctctctctctctctctctctgtgactataataaataataaataaaaattaaaaaaaaaaaaggaaacctcccaatgtagaacattaggcaaaaatatctttcaaaaatatacaatagccaaattatggaagaacctatagatagaccatctatccaggggtctgtggatagatgaatggataaagaagatatggtataaatatacaatggagtatttttcagccacaaaaaagaataaaatcttgccattttcaacaatgtggatggaactagtataaatgctaagcaaagtaaatcagagaaagacaaatataatatttcactcgtggaatgtaagaaataaaaaaattgtgagcaaagggaaaaagagagagagagagaaaccaagaaatagattcttaactctagagaacaaactgatggtgaccagaggggaggtgggcagggggatgggtgaaacaggtgatggggattgagaagtgatttgttgtgttgagcactgagtaatgtatgaaactgttcaatcactatatgatatacatgagactaatataacactgtatgttaactatactggaattcaaattaaaacttcataaaaaatatctttcaaaaacaaaggtgaaataaagacatcgtcagatatataaaaacttagagaattcatcactagcagacctgcacttcaaaaaaagttaaaggaaattcttcaggcaaaaagaaaatgtaaaaatgtgaaccttcccaaaggaatggagagctctggcaatggtaattacttgagtatatcatctttttctcttatcacttaagtctttaaaaaagataactgtgtttaaaaaatgataatgtgggcagccccggtggcgcagcggtttagcgccacctgcagccctgggtttgatcctgggcaccctggatcgagtcccacgtcgggctccctgcatggagcctgcttctccctctgcctgtgcctctgtctctctctctctctgtgtttctatggataaataaataaaatcttaaaaaaaaaaaaaaagataatgtactgtagggtttgtgccccgagaacatttaacaaaacagaccatatttggagccataaaaaagcactctctctatcatgaataaataaataaaaatatatttttaaatgtttatttatttatgatagtcacagagagagagagagagagaggcagagacataggcagagggagaagcaggctccatgcaccaggagcccgacgtgggattcgatcccaggtctccaggatcgtgccctgggccaaaggcaggcgctaaaccactgcgccacccagggatccctaaaaatatttttaaaaaaagatttatgatcattgttttatgcatctatcttataaatcatgtaagaaacaaaaaggaggatttacataccaaaaatacaataatattagttttaaatatttaccatgtagttacctttaccagtgatctttatttctttatgtggctttgagttatcatctagtgcctttttatttcactccgatggagtcactttaacatttcttgtagggcaggttactagcaataaattccataaatttttgtttatctgaggatgtcttcttaattttgaaggatagtttttctggatatagaattcttggttgacagttttccccccttcttatcagtactttattttagctatttattttttagtaagtgtaactttaaaaatatggaatgcttcatgagtttgcatgtcatccttgtgcagggccatgctaatcttctctgtatcattccaattttcatatatctgttgctgaagcaagctccctatcagtactttattttttttttaaagattttatttatttattcatgagagacacagagagagagaggcagagacacaggcagagggagaagcaggctccatgcaccgggagcccgacgtgggattcgatcccgggtctccaggatctcgccctgggccaaaggcaggcgccaaatcgctgcgccacccagggatccctcttttaaaaattaaaaaaaaatagaacactattgcaaaagtaaatcctttaatatcagtaatcactttattacgactatgagttttttaaagattttatttatttattcatgagagacacagagagaggcagagacacaggcagagggagaagcaggctccatgcaggaaggccaacgtgggactcgatcctgggactctgggatcatgccctgagccaaaggcagatgcccaactgctgagccacccaggtgtccctggaatattattattcatccttaaaaaagagtgaaattttgacacatctacaacatgtctgaacctcaaagacattatgcaaagtaaaaaaaaaaacagttataaaggaaagatgcttacgatttcacttatgaagtatgtagtactttacatacactagtaataaagtcatagagacagaaagtagaatggtagttgccaggcctggtggggtaggggtaagtggagaattatttaatgagtatggagtttcagtttggagagatgaaaaggttctggagatggatggtggtgatggttgcacaataatgtacttattgccattgaactgtacactttaaaatgatcaaaaatattctttaaaaatccaagtatatactgcttataagagacttgttttagacccgaagacacaaataggctgacagctttgaaaggatggaaaaacatattccatgcaaagagtaaccaaaagacagccaaggtggctctactaatactagacagaatagattttatattattttgttttattttaaaagattttttaaaaagattttatttatttattcatgacagacacacacacacacacacacacacacacacacacacacaggcagagacacaggcagagggagaagcaggctccatgcagggagcccaacatgggactcgatcctgagtctccaggatcacacccctggcagcgctaaaccactgggccaccgggactgccctatttttaaagattttatttatgagagagagagagagagagagagagagagagagcgcacgagcatgagcaggggggtggggggagaggcagagggagagggagaattagggagtctgactcagggctccatcccaggacctgagccaaaggcagttgctcaacggactgagccacgctggcacccctatttatttttaaggatttatttaagtaatctctaccccaaatatggggcttgaactcacaacccccagatcaagtctcatgctctactgactgggcaagccaggcacccctagacaaaatagatgttgaatcaaaaactgttgcatgagggcagccccagtggctcagcggtttagcgccaccttcaggcctgggtgtgatcctggagaccctggatagagtctcacgtcgggctccctgcatggggcctgcctctccctctgcctgtgtctctgcctctctcgctctctgtgcctctcatgaataaataaataaaatcttaaaaaaaaaaaaaaaaactgttacaagagacaaaggaggacattatatactgataaaagggtcagtcatgaaggagctgtatgacgcaaacaacagaaatgaaaggaaaaataagacaaatctacaagaagagctggagatatcagtaccctaccttcaataatggactaaatatcctatacagaaggtcaataaggaaatagagtatgtaaaaaacactagaaaccaactagacctaaaagacatacagaacattcccaacgacagaaatatgctgttctcaagtattcataaaacattctccaggacagaccgtgttaggccacaaaaaaaaaattttttttcttttttaagatttttttatttattcatgagagacagagagacagagacacaggcagagtgagaagcaggctccacgcagggagcccgacgtgggactcaatcccaggtctccaggatcatgccctgggctgaaggcagcactaaaccgctgagacacctgggctgcccttttttttttttttttttaagattttatttatttattcatgaaagacacacagagagaggcaaagacacaggaagagggaaggagaagcaggctccttgcagagagccccatgtggaactcgatcctgggactctatcccaggactttggaatcacgccctgagccaaaggcagacgctcaaccctcaaccgctaagccacccaggtgtccccacaaaacaataaattaaaacatctcctaacaaagaaaagtccaggaccagatggctttactggtaaagtctaccaaacatcgaaaggagatttaacaccaatctttctcaaactcttccccaaaacagaagaggagcagaacactttctaacacattctatgaggccaccattctttaccaaagccagagaaagctctgtaagaaaactctagaccaatattccttatgaaaaaaatgaatatagatatattcattctcatattcttataaatatagatataaaattctcagcaaaatactagtaagtcacatccaatggcccactaaaagtgattatacattgtaaccaagtgggatatttcttggttatgcaagatatttatcttgggaatgcaagggtgaattcctaggaaaataaacgttggcacatttatagggcaaaggaaaacaaccacgtgattatttcaatagatgcagaaaagcatctgataaaaactcaacatcctttcatgataaaaatactaaacaaactaagaataggacagccttctcagcaaatgatgctggaacaattggatatctgtgcaaaaattatcaacttgaatctatacttcgcaacacatacacagtttatggtgtgtgattatacttatataaaaaaaccagcaaatgcaaactaatctgtaatgacagaaagcagatttatgtttgattgggtattagaggcctgatggtcaggagagtgggatcataaaggcacaaagaaacttttgggggtgattaacaggtccattgactccgttgtgattgtttttttttttttttttttttttaattttttatttatttatgatagtaacagagggagagagagagaggcagagacacaggcagagggagaagcaggctccatgcaccgggagcccgacgtgggattcgatccggggtctccaggatcgcgccctgggccaaaggcaggcgccaaaccgcggcgccacccagggatccccgttgtgattgttttatatgaacacatatgtcgagacttatccaagtatacaccttaaatatgtgtaatttattgtatgttaattatacttcaataaaactaaaaaatatatgagtaaataatgcctcaaaaataatggaatgcccagtgggttatcagtgcacatttattttataaatgagttaatggagttaatgatgtcactcagtggaccaaggattgggaagggggagacacaaaaagaaagaggaaccgagtctgtagcagaagcttatcagccacagtcgtgttgctcaggctcagggccaggctgggtcaaatttccctgatcccaccactgctcactactgttttgtgccttcaagtcagtcattcaccaccatggaatttcatggagtccctacctccaaaatgtaactaataataatcacttcacaaataagattattgttgattgaaagaaataacagagaaggactaaatattaggtaaataataagatgctgcataaatgtaagggactatttcctttccttttttttttttttataatgacaccgttttgttttattttaaagattttatttatttattcatgagagacacacagagaggggcagagacacaggcagagggagaagcaggctccacgcagggagcctgatgcaggacttgttcccaggactccgggatcaccgcctgcgccaaaggcaggcgctcaaccactgagccacccaggcgtcctgaccccgtattttttttaaagacttatttatttatttgagacagcgtgtgcatgtgaacatgggaaggggcagagagagaggacgggggaatcccagactccctgctgagtgtgggccccaactcggggctcatcctgatcccacgacccctagatcatgacctgagctgaaacctagagtcagactctcaacccgctgagccaccgaggcaccccatttccttcctgatttttttttcctgattgcaaaaaaaaaaagttactctcaagagttggagaatatacgacataacaaaaaaggaagtaaaattactcctaatcccagcttcagagggtgtttccttctaggcttttactcacatgggctcacttgtgttaagttacttggtgttccgcctgcagctcctgtgcgttcccagctccacgcctgttttaagtagttcttttatctcttctttttttaaagattcatctatgtatttgacacaggggaaagagagcgtggggcgcaagggggcagggcggcgggcggggggagggagaagcgggctccacgctgagccggggctggtgcggggcgcgaccccgggccctgagccaaaggcaggtctgagccacccaggcgccccccactttttttttttttttttaaagattttattcatttgagagcgcgagcgagcgagtgagcatgaggaggggaggggccgagggagagggaggggagaggccgccgggcggcccgacgcggaccgggtcccagggcgcgagctccgcccgagctgaaccccgagccgcgcccccacgcggctgcggcgcggcccggcgctcggcccggggggcggggcgggggagcctgggcgggctcctgccccgctggggctcccccgcctcgcaggtgccgccggaagctccgccgcagggcccgccaaaggcagccgcacccgagcgcccgtgcggaccgaggcccgcgcccggccggtcccccagaggcgcacgcgcgcggtcgggggcgggggcggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggggcgtagccgagggccgtccgcccgccccgcccgcagcgcgcaggcgcggctggccaggtccctgctccctccggctggcccccacgcaggctcctggcccgggccctccagggccccaggcatcagctccctcagcgacgacgtggagcccgaagagcccacgcctcgggctcggcggggaggcggcccaggggtggttggaactggtgggggagcgcttcggaagcggctcggacggtacctgtctcaggtcgagctccccaccgagtaaaattacccttgacgccacccctcgatctgcaaatccccacagtgccctgcccttctcgggccttaattccagcgcggctccccttgctggtctcagacacaggccccaccggagggaccagccttctgttaggtcctgccccggggccggaaagttcccagggtcctgagctcagacataaggggaacagcaggaatgggggttccctctctgtgaggaagcacctctccctttcccctcctctaacccacaaactcaagggtgcggaagaggccccgtgggtgctgtgccgctagaacatcacccttaccctaagggaagagactgctatggtgctcctcctctccctgccgcaaactccccgtcccgagaccccggagggcaggcggcacggacttccttcccagtcggggtgtgtgtggctgctatagctgtccagagtacagggtgacattagggatgcatttccttgtgttgtggacattcccaaaacatcatttggctctttgcttcctccaacctacatttcttcggtacctgctctgaaccactcatctggataccaagaacagagagatagccgccctgccttagagggtgccttcagggtcagggcgtgtacaggatttccacaactccgcctaggggagaggatctcagagatctttcccaaaggagggcacatgtgagctgtgaagcagtgcaatggtgtatgatgcatttggagaatcgcaagcagttcaatgagatctgaggagaagcagcgcaagattggtggcagaaaaaggatctgtgaaggtgggcaggggccaaatcacaaaagatattgggtgctcatctaaggagttggaactctactctgaaagctatgggtaggagaatcagaagtgttgctgggcacaccagtgggagaagggaggggccagtgacgtcagatgagaagaaaagtggcctttggacttgtcagtgtgacagtcactgaccattgatgggtggtactggaggctcagtggaggggagacatgagcccacggtacatggttttccctgggcaggcatagctcttgcatggtggcggtaggaatgaatggattaattcagggatgcagttctacagcgaggctgcaggggaagaacagggggacgaggaggctgggagtagatgatggtggatgagtaagcaatgaagtgatgagcaggggttagactgccactggctggacagtgatttgtggccagagcaggataaccattttttaaaaaaggtattttcaggggcccctggctgactcagtcagtaaagcatatgacttttgacctcggggttatgagttcaaaccctgtgttgcgtgtagagattacttaaaaataaaatgggccacctaggtggagcagtcagttaagaggccaatgcttgacttgactcgggtcatggtctcagggttctgggctggagccccgggtagggctcagcactcaccatggagtctgtttcaggattctctctctacttcggcctctgcccctccccctgctcgcttgcatttgctctctctctctcaaataaatacataaatctttaaataaaatcttttttaaaaaagatatcatcatgtcaacagagacaagaggaactggacacgtccagggaggtatattctctgctcagagttccagactagcacactggtgaaaaaagaggaaaggcctttctcactgtgcctatttcccaatctgtaaaacgagaggcctggacagatgatctcaaaaatcctccctagccctacatgtgatgattcattgctgttgccttagttttatcctcttcacacctgcccagtgtcatgaccacctctacaccctcaatggatgttgagttccttttttttttttttttttttttaagagcttatttattcatgagagacagagagaggcagagacagaggcagagggagaagcaggctccatgcagggagcccaatgcgggacttgatcctgggaccccgggatcttgacctgagccaaaggctcaaccgctgagccacctaggtgcccaatgttaagttcctgatggcatctctcacatggacacctggcagggtcctggcacaccatcagtgcccaacctattgactgagtgacactggtatcgagacactctccctctgcctccccagtgatgatccttcatggggtacctgtggatcagacacaaatccagccttcattcaccacctcctaccttcagtgtctgcttgcactggtccaccgtacactctgaagtgaccaggacagagtactactgagtgggtgagaggacaggctctggtttctccatttattacctgcgtaacctcagatatattacattacttctatattctattctaaacgttttaggacttggggcacctggggggctcagtggggtaagcatctgcctttggctcagttcatgatcctggggtcctgggatgaagccctttgtcaggcttcctgctcagcggggagtctgcttccccccctccctctgctcctcccccattcatgcaagtgggttcccttgctctctctcaaaaatcaatcaatcaatcaatcaatcaatcaatctgtctttaaaagatttaggactcattttccacatttgtgaacttatttttacatatgttgtaaggagctaattttatttttttccatttggctaggcagttgttctaacaccatgtaccgaagaacccggtctttccccactccgctgcatagctcctttggcttttactgtattccctcatgtgcatggcttcttggtcccctgttctgttttctcttttatttctctatcacatcgttttagttgctatgactctatatgaagtctttttttttttttggcacctgatttctttctttctttctttcttttttttttttcaggtttatttaacttaagtaatctctgcacccaacatggagctcgaactcacaaccctgagatcaagagtcgcatgctcttcagacggagccagtcaggctcccccaatcttgtctcagtgttgatagaacataggcctttccttgtagtcctcctgtattttcccttgtagtttttttttttctttctttttttttttttaagattttatttattcatgagagacacagagagagagagagaggcagagacacaggcagagggagaagcaggctccatgcagggaccctgacatgggactcgattctgggactccaggatcacgccctgggccgaaggcggcgctaaaccgctgagccaccagggctgcccccttgtagtttttcaacgttatctttagacatccttggtactttaccctatgattttttttttttttaagattttattcatttgaaagagagtgagagagagcatgagtaggagtgaggggcagagggagagggcgaagcaggctctccgctgagcaaggagcccgacatgggacctgatcccaggaccctgggttcatgacctgagccgaaggcagatgctcaatctacggtgccctaccctatgattttttcaaattagtttgttcaattccctccaaaagtagtctacttccctaaggctctgttctggttatcagacaatggtaatgatcacaggtcctatgcaccgtggggatgcagagactaaacgtaaagccgtggacatgctgcttggtgctaaggtctggagcacgagggccactcggtacacagtagcatcatcttcctcaactgtccaacccaatgcagtcactgctctgttttaaaacctttgttggcttcccagtcatgcggagtaaagttcaaacagcctgcaaagccacctgaccccggctgacctttcctgtggcatctcctgcctttctcatccccgcccactcttggtgtcatgttctagccccacttgctgtccccttcatccctctgcatctcttatgatgatggctcctctgggaaggagacagtccctccctcagcctccttttttttttttttttttttttaatttttttttttttttatttatttatgatagtcacagagagagagagaggcagagatataggcagagggagaagcaggctccatgcaccgggagcccgatgtgggattcgatcccgggtctccaggatcgcgccctgggccaaaggcaggcgccaaagcgctgcgccacccagggatcccctcagcctccttttgatcacacttgtcactctgcatggtgattatttgttatctgctgtgacttcgtgaactcagcacagccctcggccatctccaagcaggtgtctgctcacaactaccactgagtgatcccacggcaactttgacgtcacacattcctccacttatttgacgctcacaacaagcatgaaaagtagacttctcccccactgagtaggagggaacagggatggtgacttgtccaggatcccagagcatggcaagaagctgagccgaaacctgaaccggggtctaactgtgatgctcacacctgctattccagcaggcggcctttcgacagtccttcctcccttactctttcccacactcctatggtccccctcttgagctctccccagcgtcccctctcaaacccgcccctagtgtttttacctcccaaggctgtcatctctcctatttcatgccatctgtcacctaagcaggtgcctctgtgaggactgcatgtcctgggtttagtacattgctggtattcaggacatagaacatggagccacatgacagcatcctcagatgcagagatgttagctgggtgtcacaagacgtaggaggtaagagacacccctttcacactccaaatgttgtctgagatcagaaagcgaacaaggccatggtttataatggcaggctttcttgggcacaactaccaggtctctagagaggatggtggaaccagcctgactcagggatgagcaagaattgtgtcagcttagtctggcttggatgctcagagctgccactctgcctaacaaagggcagaggaattgcaatgcatgttgtggcacactgttcctggtgctggttccagcagtgtcagagctgcactggtgtcctttgagctaatttcctctgctcacccatactcaaacttttggggactctttagacctctcagtagccacaagtcctacaggctattggaagactgggctgcagcaagataatactaaagtttgcatttaccctctgagttcaatgcagaccgatcaacgtgtagtaatgtgatggtgatgggacacctgcacaatggcccatcataattggacatgggtgagtggagagttccgggaaccccagatcccaattagagattgccatctggtagtttcctaagtatagcacatcacttgtgtcagcgtttataagctcatggcctcattatgcacactaaatctggcaaaagaaagaatcctttgataaaggaggggtaatcatcacaggatggacaaaggaggcctacagaatcagagtttagggagaaagggcaccctgaccagctggtagggcatctgccctgtggtggaatgaaatcatcgggttactattgttcagcaaccaacttcctatttttggctactcatatagatagccagtgtgcactagccaggttaacttggtttgacatttatcatcatacaaaagagccaactgccgtccaggaacatccatctcagtctttttatgagttcggttcatgagagtctcattctggtagtgaccctttgggtacacggaccatatcaaaacttaccaaaacttaccaaaacttggccggtgctgatgccgccagattcccagggaggccagcctgcctcagtggatggacaggcttacgtgattgtgatacgctgtttactcctgcttctctgtccctctcttcgttcccaggttcattcacccccagtccaaatcacctcatgtatgggatatcataagcttccaaaccacttctctccaacctttcctgctgcctcctcctcaaacatggttgttattacaggactatttttatcttgttcaagaatgcttcacgtgtatgaagccaaattccctggcctggcttttgctgtcttccataatttagcctcatcatgctttctttttcatgacagctcaaaatgctcctcgtctgtctcccaggtcactcagtgtcgctctctcacggatggtaccctgccttctctgcctgcaagttcctatcactacacatcttcaaaacacggtccccgcccatcagcatcccccaccaaagtcattggaaaggatgggagacaaggttcttgaaataaaggtttcctgaccctaccacgtccacctcttgctcccacacaggaaagcgacaccctgctgtgctcttgtattgtcttgtatgtggctcacctctgtccctttcatgtccctttgggctcttaggaaagcctcgctggcttagggggagaggccctctcagcgctgggcactggcagtccacccaagaaatctccccgggcaccttcagcagtgctggcaagcggagacaaaacgcggagtttcactgcctgccacgggcttctccaattcacttctcacttgaagtccccagacagcacatcttccacaggcacctctgacttccagagcaactctcaagacctcggcagaaagtgtgtgtgtgtgtgtgttgggggggggggttgtcaaatcaaaaccagactgatgtgaaaggctcaaggaaaacctcaagaaagaagagacactaagcaaggttgtgtgtgaaatactggtttttattggttggcacaagattacaacctacaattccaatgcccttccctcccacacagttcaaatggaaggaaactgatgaacacatagaaaggaacagcacgctcacaggattaagcatttgtttttataaaaaggagtgggatatgggaatggtggaaccttagggaaaataccaaagctctatccagactctatccagaccgttgctggcaccacagaagcagacaccttagtacaggagaattgctacatacaactggcctattatggaggggaaagtggactcccatcagctgtgctcctggctggactgtttccttttcttttcagcccttcctccacagccctgattgtccccacaggaaagcgaggcatgaaggaagcctaaaaacacccgccttgagaagaggaaacaagaaaattcagttttggctgccttctctggaccaaattccactgcccttaactcaaaatggcactatgcgggtcttcctacgagaagatacaggggaagaggccaggcctgggcaggtggccccaagtgggcaggaaggaaaactggaactttccatgcaataccaagcaaggctgttttggaaacaaaaaatggaaaataagtccctacagccatgggttggaagcttcaaagtcctggagtgcatttggattgggctaagggtgatattattccaaaccccagtttcaagctgcagcatcaggtcgcaagaggtaaaaggaccataaccaactccttccatacaagtgctgtccctcagtttcctcagttttgttgagctcacgggggttatttctgccaaccttgccaaggatatgaatactcagcccattgggtgttccactttctaccctttctaacaaacaggaggcacaccgcctacgcaggtgatacacatacactcactctgtagaatggtcaccaaaggactccggtgacctaatgacaggaagggtaagtcgtctgcttttctaggcagccctgatggaaggggacaacagcagacttctggtaggatcaaaacagtctggttagagcatgtgggttcccccaggggactggtccctgggggcatgggcccccagctcttatctcacttctggagacattatcagacttgatgttttaagactcagctaaaatgtatgagcactagggggaagggacaaagacgatgtcctctggggaaaaaagtcaaaacattttagctacatgcctcaatttaggggggttctctggaaataccagttgaactcggccaaagggagactgcatctggacaatacacttgcaaaaggggaggaagcacatctagttcatctgtttcagaactggaatggtcccagggattttcacctttcggatgctgatggtagatgagtgacgtggagggaatcacagtgaggaaatcccttaaaaaaaaaaaaaaaaaaaacaaaaccctcagactgtttagaggccacatcctacagcccagcaaacggagctggggcctcagtgcctcctcagagatcatcttctaccaatgtcattgtagaggaggggaggtaaggtccttgaaatgaaggtggggttggccagagcaaatttaaacatgctatgaaccggcttccatattctctctgatacacttgggtaggctagagccacttgctttatttttacaacagttcccaacatcctcaaatgctcctgacttccttaagcacatggcaaactggcagctatctttccttcttaggaactaactaaattttacttattctaaccatctgccttttcttggataaactagtttgaaagttttcagaccacaaaataataaaaacagacctgatgtgaaaaaactgcaccacatactgttatagagtggaccaagtgttttactaaccactaaacacaaccgtgtgctgctgggccctggactcactcatgcatctgtgtcccgagcaaaacatctatgtccatttgtaggtgggagtgacagggggaggttctcaggggctaaacaaaacacctgaagcaaatgagattttagagaggaaggtccccttggattctgagcaaaaaatgcataagctatgtgagaagcagcaaaagggaaggtctgtctgcaggctgtggcttcaatggctgccattcccattggagcttcacgttcttgggaggaatacaagctgcccacttgcctgagcaaaggcccttgaagtcctcccttcatttcaatgccttggaagttctccaaaacctaacttcagatctgttccctgtggaggctgtatgtgggacagacccttctggtttgtgggtgtcttgactatcagcctctaccttcctaggcacaagtcattatctgttacgccgctggatctttagataatttgttagtgatacattttccccaacaaagaggttagaggccaaggtttaaccctgaaaagctttttttctctcccccacaacgggacaataaagagcgtgacagaggctaccattttcaagttgggatttatagacaatctcactggaaaagtggtttcctgaaggtggcacttcaccccatactgggggtgggggctgggacatacagtctcaaggctgagcactgggatttagccatcttgctatttccctaaggaggcccaaagacttccaattttgatctaaatgcctgattgggccctcaagcccacaacaattttactaaattgtcaaaatgttctctgaaaggtataccccaaagataacttccacaggcagtaggcgatttggcaggtaattgttccagaaccagaatttatgttccttaagtcaatgaatacagtcttcacatctggcctggctgcaaagtgtgtggaaggatgggcagcacatcaaaatggtgaacttggaaagtaacaatgctaccgattttgtatcttttaaagccaacctccagggttttagacacttttggtgttctagggacctctttgtgggattaagaactgagactataaaccaaaggaaacctagaattattaaacaactgattggtggaggaacagaagaaatgcctgtctaccttttagatattaatcttgctttttttgtcgaaaggcactttcttctccagcagaatccttcctggtgtgaattctgagttaatgtagcatccctctgagctccccttcaagtggaccgtctcattttttcagacaactaaagctccataaatcttcactataaacaaagcttcaggggagagacatgctttttccacttagaaagcttcatattgcagactcataatcatgtgactgtagcctcagctcaaggagcatgtccaaatccaaccaaatggcattctttctttgtttgtttgttaattttttaaggggactaagaggacaaactatttgatgaatctgaaggtgagaggtatcattttctcaaatgttctgattaggcttctcacatccccgaaaggttatcagctatggccaaaatgtgcagctgcctttgtaggggcagaagtagaaggcttctggcctttaaaggagagcctaaaatcttcagcttgccagggactgtggtgatctcaagccacctaatcaacagacaacagtagcttttatggactgcagccaatgcttcccaatttaccacctgaacatctcaagtgtctcactgctttaggtgacatctaaagtgacatggaaaaaacagctcttccaggatggcgaggtctctgttgcaaggctcactcccaagaggacagaagctggccctgggctgctttccggcctattccaagtgaaatgggtgcccggatggaccagggatgaggtcactaacatggataactgcacagcctggaagccccaccacccccaccctctacccccccgccttgaggaaatgggttcctctccagcagggctcagaaggaaagactgtcgcctcaactgggcagtatgacccatgtagcttcaggtctgacctcttagagtttcaagaataagaaccacaggggctgttgcactatttcatcaccattagatagtttcaccccagagcctcttgagcaaacatgcctcctatttgttataaacccgtgtggtattttctcaaatgcagatggaacaggacgaggcttgatcatcagttacagctaatctccatttcccttaaagcaaaaattcggccctctgtgacttctccaggtagttcttcttattctaaatttcctctcaactagtctggacttcaagaataattcaggaatactcaaattcacacagttgtggcaaagatcccgctgtgattattaaatcctttttgggaaccaaaagaaatgtagcttgggctatgctgttttaaaaaaagatcaggtggggagaccagcagaggcattactccagcactaagtggaaatgacaagcacatccagcacgacatgtgagctgcacatccggatctagcagaagacacattactccttggaagagaggtttggagttggggggctgctccaatgagcactgcatgtgggcaagagaaaggggaaggaagaggaagaatggttctgtgtggacatttttttctttttttcaaaacaaaaggtgattttttttttctaagctagtcaagggaccttatgtggactgactcctaacatcaaaacagaaaatatgtgtaacgaaggaacttgactgtatagcaacgtgtttacaaaactgctgcaggactcccagagggcagtagcctgctctcctccctagagcctgcgagaggcaaggcctagagctagagtgcactgtatccggccacgcagagggtggaaatcctgcagtgaagccaccttccaggccttctgtggcctcacaggggtgttacttccatactctttgatccctccagatggcctcagctcagactcagcagtgcgggagccttttctatgcagggcagatggggcagcagacacttgtaaaaacaaaactgtcaatttgttaacttttccatcctgctagtttagctacaagaaagatcaagattcctatttcatgtgctacaccattctggaaggctacaaaaagtcgaatagagctgactcctggtagtcctttctctttctttctttctttctctctctctctctctctcacacatacacacacacacagtcctggtcccaaaagacggcatgacctcactgatgcattcccagtggctgcaaattgataaactaaaaacaaagtttcatttaaaaatatccaatgctatctttctctattctgagcatgttggactgtgatgggcaccctagaaataaacagaatccaggacaggcaaattcactgtgagaaagaaactttatgggcagccccagtggcgcagtggtttaagcgccgcctgcagcctggggcgtgatcctggggacacaggattgagtcccacttcgggctccctgcgtggagcctacttctccctccacctgtgtctctgtctttctctgtgttgcacatggataaataattaaaaaaaaaaaaaaaaaaagaaactttttatctgccctgtaccccagaagctgtttgtgtcaagcctgaataaggggagtacttgcagaattcatggtaaatcggtgtcaaagaaatactccgcaagtgggatcatttttgtgctttcttccatttctccttgctttctttggggaagcatataatggctaccgcaaccgtggtctaagtaatccatcacaaaagggcgatgactacacatcagtgaagatagccatggtgttatggtgccagggagggaaaaacaccaatccccactcatcaggatcccagtgcaacagaaaatagcaccagtttcaacaattctggcgttggacaaagcctctttttgtcagttaagaaagcatccgcacaatctccccagttaactgcattaataggatccattcatgtcactgaaaaatacttcttggcacagttcactttcctgacccaagacgccaacatcaatccaaactggactcggtggggaatgtgttgtgacaccagcccagtaaaaacatctttagatcatgaaaaaatgcacgaattactattaacactgcacttctctttttaggagcactgcctgttttcctgcaaagtacttttgaaacagatcgtaaaggtagaattgagctggaaggatgtgttttttggatacttagtgcttggttgaatttattacattttctcctttactcctatggacagaaactccaaatgctctcaactgggcaacaagcagcaggatgtttgtttctgagcaggacatgcgaacagtgggctggtatttagactccagtcccatgtgctgttcctgtccactgagaccctacttgggacaaattcctttcccagaggtaggacagtaacctaaggaagctgtgggcactacttgttggttctgtgtctcaagactgggagagaagatgaaacacagcagacagcaagatttaaagttcaccgcaagattcccccaaaatgttaaacactgaatgacacaggcctacgtcatgcatacacatacatcttctagtgggagggaagagcaaaagcttttcaaaatttgagtatttattagaatttttaaataaagagaaccacaatcttaatttcacatcttggctatgttttgacaaaggagatgccactcagagtacagcaacaaactcctgccctagccagggactgatcagtgtcaaaccaactggccccagccctccatctcaagaccctttcctgtttacttcccaactaaacaacacgactggcaaatgaagccagcatgaagcctgtatcaaaaaccaacacgacagttgctagtgaccaatgcttatgtcgctactctactaaacgactgagcattttcccataccacttctcagcagacatcgagaccttctgtatcccagcaggagacaaactaagtatttctgagcatgctccatggtgcaattccaagtgctgtagcattacaaagataagcaaacacctgaattttcttcctgtgtacttttcaggaacttaacatggttacccaggatggggaaaggaccatacgcacacacttgccaagtacaagctggatgcttcagcacaaggacaatatccagctcagcacggtgtaaggcatgtatgcacaaggagaggccattgtcggtgacaaggagtattatggaaaaaattcccaccagcaggacagaaacagtgcttgaagctccagttttttagatagtaatcccaagaatccagttcaaatccctactgtcaacacgtagggaaggaattcaatttctaccactgtttctccaggtctgagctgaggccatttgctggcttggtaataaaaagggaaataggtttcttcctgtttctttcttggcatggaaacacagctttcaggagagaaggccatgagtcctgggactgctacgaaggtagctacactctttccgtaccctatgtaactacagtcagtgactgggaaaagggaggacaggaaagcttacctaaacactagcatcaaaaacaaaaagggaagttaactgtgaggctctccattttagaaacacccgaatttaaaaaacaaaaccttgaaaaattaaacagctaaattcctcttctaaaagtcatttatttacatattatatgcccagtatataatgtgtagataaatgtatcctatggtggaagtgaccaacctactggactcaatagagcattacaggacaaattcttgaaaggtttcatctcatattggtatcttttaataaaaaaaattaaaaatcaaagaaaaaatgtctggccagggctggggtgagacaaacaggaacacttcagaatccaagccagagggaaggctgtttgtctctttagacaattgtaggggtgtgaaaaggaagggagcaatcatgcacaaaagtacttacaaattacatacccaccccccaccccctccataaaaagagaagaaaaagcccacttaacaccaaacagcaacaccatcaagaacccctttctctgctgcccatcatgccttatttggagaggaggcctgtgaggagaggtgaaaagagcaagggagggaagatctgcactccagtctagttccaatttccattcctcttacgcgaagtcttcagtcatctgatgcctggcatggagctctgggaagaaaccgagtacgtggtggccacgaccggggtgccattgttggctgagtagccttgcctcaatgtttcaaaatacgacgcctgcactggtttgtgatactgcagcacttttatggcatcttctattttaaaccattccctcttccttcctgtgggggcagagagaaaaagaaatgagggcaaaagggaagcagtggcatgattctaatcttacaacttgggagaaagtgtcgatgaaaacaagaaggcaacatcatcaagactttaaaaccgtgcatcataaaggtatttttcctcacaagagtatatgtttcaaataccatacagctgccaatgcccaagaaaggaagacatctgagaagtgaactgtgtgaaatctgccctccagggagaaccactgctcctggtttcctcttgagttcctgcgcctctgagccttgcccggcttgtatggcaacacctgaagcccagccagcaccccccatcttctgcataaatcaacacaagagtgagcttctagaattactaggatggctgctttataatcagttacttattttattttattttattttattttatttattttattttattttattttattttatatttttaaagattttatttatttatccatgagagacatagagagactcagagacacaggcagagggagaagcaagctccatgtggggagccggactcgggactcaatccctggaactggtgatcatgccctgagccgaaggcagatgctcaaccactgagccacccaagtgccctttcagtctgttttctttccttttcgtgtttaagatcctttatttttttctcttataataaaagatcattgcttaatactgggaaaatggaagaaagtgtaaagaatatgattaacacaacattagaaaccagaaatgactactctcaatagctctgtgcctttttctttcatcacatttgaaaaaaacactgcactgaacagctataactgggatcatgctttcagatgctttaaatcccgagaagctctaataagagtgttgtggttagaatcctggacgctggagctaatatcctgggctccaatcatattggtcagtttggggcaagttactgaactaggtactgagctgtgccccaccttcctcatctatagagataataaatagtatctatctcacaagtctgttgtgaggattaattaatatgtaagacatttgaaccatatgtggcccatagtacatgctatgagtctgcttattattattattccttctttctatttcacactgtttcttaagtgctcttctaagttataaaaaatatgaggggcgcctggatggatcagtcagttgagcatctgaatcttgattctggctcaggtcctgatctcaggattgtgagatggggctatgcactgggcagatggggcctgcttaggattctctctccccctttccctcccccatcctcccactcccccagcatacacacactctcttaaaaaaaataaaataaaaaagctttatgtgctttttctttcttttctttttttctaaagattttatttatttattcatgagacactagaaagaggcagagacataggcagagggaagagaagcaggctccatgcaggagcccaatgtgggacttgaacctagaactccaggatcatgtcctgagtcgaaggcagactctcaactgctgagccaccaaggcgtccctgttttttctttcttttaacctcccagaagatgcctagaactgagatattaggaataaaacactgaactcggaaggcctcgtgttatataatgccaaactgttttccagagaggccatcccaatgcacagtcctgcttgtgtgtgctggaatgtcatttttaccacacctgccagcactgctaccttttcttttgtcattgccaattctttaggtgaaactgagaactttttaaattttcatttcaaatttattttcatgtagctttaattagtgtatatatatacatatgtgtgtgtgtgtatgtgtatatatatatgtctgtaccctgctttcttcattcaccaacactgactcataagcactttgccatggtagatcagttttcataagtacatgtttaacagttgtgtaacagtccatcagatgaatgtactccagaacacttatccttcactgaggcatcaaatgtttgagacccaatttctacctgaaaagggctcatctgcaggaaggctcataggcttattctccatattttagattatttcaatatttcaattcttggaagtagtataaggtgaaaggcttgctggatattaatagagcaatggtaccttgaaaattcatatcacaagtgtgtgactcccgcctgacagagtgctctgaggacagggccatgccacattcatctctgtctcctttttaagttttagcactagctgtcaaggagtctatttttaataaacccctctgaatttgtttacttaagcatattgcattcttaccagatacaaagctgttaaaagctgaagggccacaaaatgcccagatcagcagtgtgaggggcatggtggcaaagcacatacacacaataaaggaaaaggttttagcaaatggattttatcccatttgccaattcataaccagtttttaaattaatattaaacttttctagaatatactttcctacagaggtaaaagattaaacatgaaatcattgaggtttttagttctaaagacacacactccgtagtaatctgagagagcaaagagagtggctccttaggagaaagggaggggcacacgaaggggaacacggctgaactggaaactgctcccactactctgtatctacgaaagggctctggagagaacagctcaccccaccaggtcagcagctttctccaacaatatgaataaacgcctgacaaggaacaaccaagatcctgctctcagctggggttttgtggccagcagcagccctagcatggtggaagatggtcagtatctgctgaggagggtccaatttgacttgggaaacaactgtttttatttttacacgacacgtttctatttgttgaccatgtacccaccttcagcttcctttaggacactgcaaaacactaattttcattaagttcaaaatggacatgcttctttcattaaacatgtccttctatgacttcttttatctggctcatttctggttctgggtcatgacctattgtgtggcaagggccctgtggtgaggagcattgtggaggctatctggggacaacttaccaatgttaactgaatcttcccagtcttccagcacttctgtgacaatgagcacatagacatacgttctgtgcttcctctcctggttctgaagggcaaagagaggacagaggaagagctttcccttagagagctgagattacttaagtgaaacacacttttagccatatgtccagagagctcagacacaggcattccatttactctgagtcgtcttatagtcacacagggaagagcaccagatgacctatctgaaacatgctgcacttgcatttcaggttgcgctctttggctggccttctaaagcccaagctttaatctcttttttctttcccctcacaggaaggctgtgagaaggaagtttgcgaccactcaagaaaaaggcacccagtaaatgtaactcgctaaaacacaagaaagagaggaggctgtgggtgggtgggtgttccagtaatgcaagcaagctcattatctcatgcatctccccttctactaaccttgctcatctttatttccccatttctcactaccttccactttcctccaaacttctatcccagcctacttcacttcgttgtttcttccgcctttcaagatagttacttgatcttctttttccttcaatcttctctacacttcatctcccctcctcaaatcttgggagaagaggaagagaggtggggatgggataaaccatccagggatatcttgtttgtgcttcatagccaccgcctttgctgtaaattaaaggtccgtggcagtgctgtgtcaagcaaatctactggtgcaatcttctcaacagcatttgtttacttcgtgtctgtcattttgataattctcacagtatttcaaactctgtcattattatatttgttacggtgatctgtgatcaatcatttttgatgttacttttttttaagatttatttatttattcattccgagagagagagagagagagagagagagagagagagagagagaggtgcaggcagagacacaggcagagagagaagcaggccccatgcagggagcccgatgcgggactcgatcctgggtctccagaatcacgccctgggctgcaggcggcgctaaagcactgcgccactggggctgcccttgatgttactaatataactgtttcccagtgccacaaacgacacctatataagacagtgaaattaacaaataaattccactgacccatctctccctgtcattctccctattcactgagagacaacaaaattaagattaggtcaattaggggtgcctgagtggcccagtcagctaagcatctgcctttggctcagggcatggtctcagggtcctaggatggagccctgccctgagcatggggctccctgctaagtgggaagtgtgcttctccagctctctcttcctctcccctgcttgtgcactctcaaataaataaatcttttttttttaagattttatttatttattcacgagaggcacagagagtgagagagagagagagagagagagagagagaggcagaaacataggcagagggagaagcaggctcccttagggagcctgatgtaggactcgatcctaggaccccaggatcacgacctgagccaaaggtagctgctcaactactgagccacccaggtgtcccaaataaataaaatcttaaaaaaattattaaaaaaggattagaccacttaataaccctacagtggcctctaaatgttcaagtgagaggaagagttagttgcatgtctcctactctactttattttttttttcttcaaatttttatttatttatgatagtcacacacacacacacacagagagagagagaggcagagacacaggcagagggagaagcaggctccatgcaccgggagcccgacgtgggactcgatcccgggtctccaggatcacaccctgggccaaaggcaggcgccaaaccgctgcgccacccagggatccctcctactctactttaaatcaaaagctagcaatgattttttttttttttttttttgctagcaatgattaagcttagcgaggaaagcatgctgaaagccaagataggctgaaagctaggctgcttgtgccagttagccaagacgaaaatgcaaaggaagagttcttgaaggaaattaaaagttctactccagtgaacacatgcatgacaagaaagcgaaacaggctcactgctgatatagagatagtctgagtggtctggatagaagatcaaaccagccacaacattcccctaaggcaaaggctggtccagagcaaggccctcattctcatcaattctgtgaaggctgcaagaggtgaggacgctgcaagagaaaagtctgaagctaacagaggttggtttatgaggcttaaggaaagaagccatctctgtaacacaaaagttcaaggggaagtggcaagtgctggtggagaagctgtagcttccagaagattcagctcaaataatccatgaagtggctacattaaacaacagattttcagtgtagacaaaagaaccttatattggaaaaaagtgccacctaagactttcacagaaaggtcagtgcctggcttcaaagcttcaaaggacagtgactctctggttagaggcagctggtgatttaaagttgaagccaatgctcaatgaaagtcctagtgtcctcaagaattatgctaaattgactctgcttgtgctctataaatggaacaaagtctggataatagcacatctgtttccaacatggtttactgaatatttaaagcctacttttgagacctcctgctcagaaaaagatttctttcaaaatattactgctcattgacagtctacctggtcacctaggaggtctgatgaagagggacaatgaaattcatattttcatgcttgctaacacaacatccatttcacagactatggatcatggagtcatttcaacttgcaagtctgattatttaagaaatatatttcataagactacagctaccatagattgtgattcctctgatggatctgggcaaagcaaactggaaaccttctagaaaggattcaccactccaaatgccattaaaaacagtggtgattcatggaaaaaagtaaaaaatatcaatacaaacaggagtttggaagaagttgacccaactctcatgagggactttgagggattcaagacttgattcatgtcattatctcagtgtcatgagattgagccccccatccagctctgtgcttagcactgagtctgcttaaaattctctccatctgcccccctgctcactatcttgctctcaaaaaaaaaaaaagaaagaaagaaagaaaagaaagtaagagaagtctagcctgaagatgggactgaactgctgctgcaatctcatgatcaaacctgaagagatgaggatctgcttcttatggatgagcatagaaagtagtttcttgagatggaatctacccctggtgaagatgctatgatgattattgaagtgacaacagaagatttagaatattccacaaatgtaattgataaagcagcagctgggtttgagaactgagtcccaatttttttttttgttgttgtttttttaaaagatttcatttatttattcatgagacacacacagagagaagcagagacacaggcagagcaagaagcaggctccatgcggggagcccgacgcaggtcctgatcctgggactgggatcttgtcctgagccaaagacagatgctcaactactgagccacccaggtggtcccagagtcccaattttaaaagacgtttgactgtgggtaaaatgctatcaaatagcttcatctactacagaagaattgttcatgaaacagagtcaattgaggcagcaaacttattttaagaaattgccacaggggatcccctgggtggcgcagaggtttggcgcctgcctttggcccggggcgcgatcctggagacccgggatcgaatcccacatcgggctcccggtgcatggagcctgcttctccctctgcctgtgtctctgcctctctctctctctctgtgactatcatgaataaataaatattatctttaaaaataaaaaatattaagaacttgcctcaacctccctaattctcagtgcccgtgaccctgaccctccaagtaatcctttttttgtcggccatgacctccgccccaaactcaatntagccattaacatggaggcaaaatcctccaccagcaaaaaaataacatctgaaagctcatgacagttaacattttttagcaatcaagtactttttaaaatttatttctttttctttttttttaatttttatttatttatgatagtcacacacagagagagagagaggcagagacataggcagagggagaagcaggctccatgcacggggagcccgacgtgggattcgatcccgggtctccaggattgcgccctgggccaaaggcaggcactaaaccgctgcgccacccagggatcccagtacttttaaattatggcatatacattaatacagacacttaagtgtatgtatacacttcacagactacaatataatataaatatgtttcacatgcactgacaaaaatcaaagaaacatttgatttgctttttttattcttttttttaaagattttatttattcatgagagacacagagagagacagagagagagagagagagagagaggggcagagacacaggcagagggagaagcaggctccacacagggagtccgacgtgggactcgatcctgggtctctacctgggctgaaggcggtgctaaacccctgagccacccggctgccagggactatgggattttaaaaaagaaagtaagctatcctctgctggtgctgctttgtttggaaaccttagtgatggtgtctatcctagattaggactgcagtggactgaatatttatgctccccacaatgcagatgttgaaatcctaattcctaatgggacagtattaagagatggggcctctggcaagtgattaggtgataagggctgattctcatgaacaggacaggactggtgacctgataaaagagaccccagtgagcaaccatcccccttttgccgtgtgagaacacagaaagaaacagctacaggtatcccctgcttttccaaagttctaggtaagccacttcactttaacgaaagatctacattagtacctgtttttggtaactgaaagaaatccgaaaaggattttgcttttatttaaaaaaaggtggaagacaaaaccagcattcagcatttatgttgcagtgagccattaaagaggcagtgcacacctggagcagcaagagtggcaggactgaactccttccctgggaactacactcagcacttcctcatcaagcagccaaagctctgaactgtggctgtgaacatctgtgctttaccttgatttattttatgatttattttatgcatctgttaacaagatgtatcctgaggtaccagaaaaacctgagagaggttattttttggtttatggaaatgctaaaaaacattttccatataaattaattgcttcttcactttctcccatttcaacttaaaaagatttcatacgaacaccctacttttggacagcaggagaaatctttaactatgaaccaggaagtgggtcctcaccagacgctgaaactgctggtgccttgatcttggacttcttagcctctagaactagaaatccatttctattgtttctaagccactcagttttgttatagcagccaaatggactgagacaaagatatacatgtatacatagcatggtgacttatatgataccaaatgcaccaaagattttaagacttacctcaaaaattccaactaatcttcccaatgtcccttttactccagcctgaaaagtaaagaagaaaaatcaacacattaatattgtttacattgctggtcttattctgaatcaaagcccaagaggagcaccttaggtggaatccaggtctctggaggtcacaccagtatttctcgagtatcacagaccagtgacagcagggtgtgctctgaggaggaaggattcctctcatctcctccccatctctctccccactgcaaagctgcccaaacataacagataatcaaggccatgaagccacaaagaagatattctgaggtgttaacttcattcattcattcattcattcattcattcattcaataaatacaccgactgcctgataaatgtcagaggtatagtgatgaataggctagaatacaagatccacaagaacaagatcctcatctgacttgttcttggctgtctgtatacagtatgcccacaacagagctcagcatcttatagaagcagctcaggaaggcttaagtcagcaagcaaataaaccaggtgattctgctagtgacagagatgcacaaatgatgcgatggacagagagagggggatgggatcatacaatgcttaggcctttatgcatatactctgtatctcccatcggccctttggtaatttttttggatctttctgatgcatcatgcgaatttctcagtttattccaattgattaattttcttttcagctgtatgaaaactaaggttattccacctctagtcatttgatatttgattatttttcatttctacctgttctttagatatcccatttccattatgtaggcatttgtttccatgatttttacaatcttttatttactttaaaaagattttatttctttatttaagagaaagaacaagtatgagtaaacaggcagagggagaagcaggctcctgcttaacagggagcccaatgcagggctcaatttcaggaccccgggatcatgacctgagccgaaggcagatacttaaccaactgagccacccagttgcctttgttttttaaattaaaaagttattccttaatttacttttgaacatcctaaacatatttaagttctttgtcagaccaggctataaaattcgcttcatctgaaaagtaaactcatgttccaactggtaaagggcttattacttgtgaggcttcttccaccaagctcttcaaagactgctcttaaagtgaccatttaggactcctgctccaaggtgatgcagcgaatattgcaggcagagccatggtatggtttggctccatcttttactgcacaccgcatctatgtcctctccctacctaggcccctatctttctaaaagtctcagctcctggtgtcctttccaccgggaacctgggctccccctactccaaggggtctgaacactagccactcaaggctgggcaggctgcaggtttccaatgacattcagcagttctaaccctgtttctgatctatggagatggtacccatcttgcttttgaactaagctatgtctttttagcttttatattttgtatctgtctctgctagaagtggggagaggtaagggaaggatgaatccctggaaatgcctgggaaatgctgtaacttgttttctattaccactgccatgttatttgtataataaactaaaaattaaggcaaaaataccttctaaagacagtaggtactcattaagtttgtacagaatgggggcacctgggtggcttagtagtcggttaagtgtctgccttcagctcagctcatgatcccaaggtcctgggatccagacctgcatcagggtccctgctcagcggagagtctgtctctcctccagctcatgctctctcacttcctctctaataaataaaatcttaaaaaaaaaaaaaagtttgtagagaatgagcaaaattaaaaaaaaaaaaaagtactctaaaagctctttagagatatttagatttttaaaaaatttattcatgatagacatagggagagagagagagagagagaggcagagacacaggcagagggagaagcaggctccacaccgggagcctgacgtagaactcgatcccgggactccaggatcgcgccctgggccaaaggcagatgccaaaccgctgagccacccagggatcccctctttagagatatttaaaataagagcaaatttataggcctagactcctaggtgagctatattttgaaaaaatttttttctaatcatctatcaaagaattcttttcctttctcttgccaacatgcctgttcatttcccatccattctttccccatgtggcttttgggtctactcaaatggaaatgttgacctttccttaaaataattctctatattaaataatttttttgaattttttaaaagttatctctctacacccaatgtggggcaaaaactcttgatcccaagaacaagaaccacttgctccactgactgagccagccaggtgccctaaactgattctctacatttttagagataattgcactccatggctagctaagactagttagattgtactttgtgaattaaccaatgtagctgcctgaacaagtgggagctggcaggccagcttagactagaaaaccaattttgtaccccaatcataggcagcctgaacactcagatcaactcttttgagatgtggtatctgtgctcctgcctgtggtccccactgacagagcctatgagcagagctgtcagattggttgcgaggggagggaagtaaggagattcatagaggccatcattcacatttcacttctgcaaagtaaagaaagagttctcttttacagttctaactgttcaatttttttcttaaagaacccaaaagtttagaaaagaaaatgatccccagctttttaaaaaaatatttgagagagagtgtgcacacacagggaagtagaagggtgggtggaggagcagagagagagggacaaaggacaagcagactacaagctgaattcagagcctgatgcggggctccatctcatgaccctgagaatcatgactggagcccaagtcaagagttggacacttaacaacctgagccacccaggcacctcaatctccaatttttttttttaaagattttatttatttattcatgatagtcacagagagagagagagaggcagagacacaggtagagggagaagcaggctccatgcagggagcccgacgtgggactcgatcccgggtctccaggatcgcgccctgggccaaaggcaggcgccaaaccgctgcgccacccagggatcccctatctccaatttttaagggtgcaattaacataatatgacagctcaatataattttattttattattattattttattttattttatttatttattcacgacacacagagagagagagagagagagagagaggcagagacacaggtagagggagaagcaggctccatgcaggaagcctgacgtgggacttgatcctgggactccaggatcacgccctggaccgaaggcaggcgccaaaccgctgagccacccagggatccccctcaatataattttattaaacttttgtctaataatggtgttttctgcattcaataccaacatatatctatgatttactgtaacaaaggcagttggaagaaagcataaaatcattttctttataaaacagatattcttataaagtctagtgtaaattacataacattgccatctgtacaaagaatttcagtagcatatattttcacttctaattaatcttcaatagaaaaaaataagttgtagaaattaacaatagctttgtctcaaagtttcaatttttttaaaaaagattttatttatttattcaggagagatacagggagagagaggcagaaacacagacagagggagaagcaggctccctgcagggagcctgatgcagaatttgatcccaggaccccgggatcacgacctaagccactggcagacgcttaaccactgaaccacccaggcatccttcaacatttcaagttttatatcaatacttatgggatctactttgcagaattctatctaaggtgatcctgccaatgattctattgtgaaaagcaaagaaatattcttatatttaccagttgctaaattgagatttagcagttttcttaggaggaggtgcctctttaggaagcaagaggatttcagttctttaaaggcatagtgatcaagaggaagaatcctcagaggtaaatgtcctctaagacagagttcactgcaaccattttacattttcatgcttccccacagtccaattagctttgagctagctccctctcaactgctgccacaagcaacagcagagagttatttttatctttcacatgattcttgcatgtgggtcgaggtaggtgtcagggtcacatcagacagctggctcagtttggggataagatttgattcagggtatatttaagtttggtctagtcagggtgctggtatgacctgttcttctccaaatcacataaaagcagttacaatttcaatctatatattcaaaacccctaatctggtggagtcttaatttaaaagctcatcttaggtagtggtaagaattctaaatagaggatctattgcacttcattattcaacaatatgcaggtgagtgcttccttgaacttcaaggtgtaatatacaccaattctagcacgtgtggactagttaacaaaaataatttgagcaactgtctactttataaaagaaaaatctctccacaaatgtcttttttttttttttcctttggggtgttttgctgagattggaagtagcagtcactgagacttcagtgatcccatcctttcctcttgtaaaaagctctcacactatgtacacgagacttgggcaaaggcactaatatggatgggtctttgagaatgcccctaaaatgatctgctgccacaaagaaccctggctttgttttagtttggatgggtacaaaatgtgtcatcaccttctaaaacttattttttactctaaggtagacattttggtagacacgatggatgcctagcccacaggtattcctccttccactttgctaccaggaagatctggattctgttcaggtaagagctatggcacaccaggaatggcactgggaattctgttcccctctgcagtgacagattcgggtgtgctgtgacccagttctggatcaatggcttctgagatggtgtctcttgtgggcttatgggaaagatttcccaccatgataaaaagaaatcctacaccttgcttgtcaagtggggacctgaaacttggagctgctacagtcaccttgtgatcgtaaggggaagggcaagagaatcactgagaagctgaatggaagtcctggtggctgagctgttgaagcaatgtggtaaatgtccaacctctggacttcttcttcttttttttttttttaagattttatttatttattcatgatatatatagagagaggcgcacagagacacaggcagagggagaagcaggctccatgcagggatcccgacgtgggactcgatcccgggtccccaggatcacgccctgggccaaaggcaggggctaaaccgctgagccactcagggatccccaaacctctggacttcctacgtgaaaaaaaataactggtacggttgaagccccttttagtcaggtattctggtactgtatcagaatacttcctgctacttcctttgatttaaatggtagctctcaaaaaaaaaaaaaaaaatggtagctctcataggaagacgaatatcccaaaacaaaaattctgaacatccaagggaactgtagtattaaagcttgctctattaaagcaataagcccagaccccaaaggagctcaggggagcaactctcatgcaagtatcttaggaggaaagccaggaataaaaatatgtggtcttcaattcacatacctttctggtaccggacaaacttaagtaacagcaggaaagagtcacagtgaagacagatgaaaggagatttgggaagtaattgtagttaagtccagtgaaatcccatcccagagtttttttttgtttttttttttaagattttatttatttattagagacacagaaagagagagagaagagaggcagagacacaggcagagacacacgcagaaggagcagcaggctccatgccaggagcccgacgtgggactcgatctcgggtccccaggatcatgcctgggctgaaggcagcgctaaactgctaagccaccggggctgcccagttttttttttttaaatgaaatctttcaaatttcaaaaaagtaaagaaaataaacattcaagtagtaaccagccagctctgtcaaatagtaatgtaccattttgtatatttttttattatttatttttaaaaaatattttattcatttacttaagagagaaagagagcaagtgagcacaaggggagaggacagggcagagggagaagcgggctcctcactgagcagggagcccgaaatggggctcaaccccaggactcaagtcatgacccgagcagaagagatgcttaaccaactgagtcatccaggcaacccctgtgtattttttaaaaaatatgtttaatttttattttaattaattagctaatcaattaattaaagactatgcattttaaaaaaagaaataaaactactcatactactgaagacccttgtgtattccccagctctgccagaactaactaactactcaaccaaatttggtgtttatcattctcttgcatggctttatacctgtactacttagttatctacccactattcatggtaaatagtattttctaaatgtttctctatttgattaaaaaaaaggattataccttctgaaaccctgtcctctcaatatcatgcttctaaatttaagatatattgcaacatgtagttcaaattaattcattttatttgttgaacagaattctactttaggaacttatttatttattattattttttaaattttatttatttattcatgagagacagagagagaaagacaggcagagatacaggcagagggagaagcaggctccatgcggggagttcaacacaggactcagtgccgggttcccaggatcacaacctgagctgaaggcaggcgctaaaccgctgagccacccgggccaccctactttaggaatttatttaccacaattaatccatttacttgtagacatttagttctgctattattaaaaaacactgcaaaaaacaataacaaaacccaaaacttctcttgcagatatccttgttacaacctacaatgtgtacaagtttaagattaaatttctgaatcacaggataaaagcttcaatttccccacatattctcaagttcttctatgcatacttcaaaggcagaaatgactacagttctctacctcttcctgtatccatgtcttttgaaatgtgattttatagctcttcctatcaagacatctatttacccacttctttatgaggctggcctagtgacttactttggccaacagaatgcagaaggatggtatacctttccaagactaggagggcctcaagaggccttgtactttctcttattcatgagagacacaagagaagcagagacacaggcagagggaaaagcaggctccatgcagggagcccgatgtgggacttgggacttaatcctggcaccccaggatcatgccctgagctaaaggcagacgctcaaccactgagccacccaggcgtccctgaatggtctagatcttaaaaggttatgtattttctaatccattactgcttttaaagaaactgctggtttctgcatatttttaaaaaccattttatttatttgagagacagcacaagtggggacagaggcagagggagagggagaagcagacttcccattgattagggagtccaacatgggcctcaatcctggaaccccaagatcatgatctaagctgaagtcagacgcttaaccgactgagccacccaggcgccccatggtttctacatattaatcttatgtttgcaacctttctaagtgcttttactagttctaccagtttctgttgtgttccttttttttttttttaattcttatttatttatgatagtcacacacacacacacagagagagagagagagagagagagagagaggcagagacacaggcagagggagaagcaggctccatgcaccgggagcccgacgtgggattcaatcccgggtctccaggatcgcgccctgggccaaaggcaggcctaaaccgctgagccacccagggatcccctccttgggtttttttgttagtaattgaatcatctgcaaataatgacaattttgtttcttccttttgaatatttataatttgtacttatttttgtcttattgcagtggctaggaccccagtttgtttgtttgtttgtctgtttaggacccccagtttattttttaggacccccccagcttaatattaaatggtagcatgatagcaaacataactgcctttttcctgttagaaatacctagaagatttaaaaaatatgatgctcactgtaagttttaccagatacactatcaggttaaggaatttttatttttagcttcctaataactttcaagatgaacagatactgaattttattttctttttaaagatatttatctatcatctattttttttaaagattaatttttttttttttttaagatttaaaaattttaagtacaatatacctccaacatgggggctcaaactcacaacccatgaatcacatcatgatcaagagtctcatgctctaccctggatactgaactttaataaataatttttccttatttactgagatgataattttaatctcttaatgaagtaaattatgtaaacattttctaagacttgtattcttgggataatttagtgtatttgctcttcttttacttgggatttttatatctgtgttcataagtgagaatttatcgttcctttctacttttaattatcagggtcaaaaaacccatgggccaaatctgtcttgccatcaatttttataaataaacttgcactggaccatagccatgctcattcactgaagtactctgtatgggtttattcatgttatgacagcagaactgagtatctgtgacagataccatatggcttctaaagtctaagtatttattatctggccctttacaggaaagtttgctgatcaccgatctgagattacaccagccttacaggtgtagttattcttttctgaaatagttctttttttaagattttatttatttattcatgagagacacacagagagaggcagagacacaggcagagggaggcaggctccatgcagcgagcccaatgtgggactcaatcctgggactccaggatcacaccctgagccaaaggcaggagctcaactgctcggccacccaggtgtccctgaaatagttctttaaagtaaaaatatatttttggaaattttggcaaagttcaattagtctgagtaaatttgtcagcaagtgattaacaattttgacaagggttaataatctgtacataggttttctaattttttaagatttcattcattcatttattcagagtaagcatgtgtgagtaaggggaggggcagaaggagagaaagaatctcaagtagactccacgctgatcgtggagctgaatgagaggctgaatctcacaactctgagatcataaccagagccgaaatcaggagttaaatgcttaactgactgagccacccaggtgccccagggttttccaatttctatgtaaatttgggtagctttatctagaaagtttttttaatcaaagttttctaatttttgtgtttattatattctgtggttatctcttattttatttatttgttgccttttctcattttctttatcagtcctgcaagaggcttgtttattttattagaaaaataaaagtaacccactttgggttttattgatcatttctattttcctctattaatttctgcccctttccttgttatttccattttttttaagattttatttatttattcatagacagagagagagagagagagacaggcagagggagaagcaggttccatgcagggagcccgacgtgggactcgatcctgggtctctgggatcattcccctggctgcaggcggcgctaaaccgctgtgccaccaggctgccctgttatttccatccttttatgttcagtttgtcttgtttttactagtctcttggatggatcacttagtttctttaatgtctattttgctttctaatacaagcctctaagtctcaaaaacctgaaggagctgtacccatgaatcatgatatgaagtgctttcaattactcagttctatatgtttactaatttttattgtgatttgtgctttaactcaataattatttagtacattttttaaaaaaagattttacttatttattcatgagagacacacagagagaggcagagacataggcagaggagaagcaggcttcttgcagggagtctagtgcaggactcaatcctggtaccccgggatcataacctgagccaaaggtagatgctcaaccactgagccacccaggttccattagtacacttttttttttttaagattttatttatttattcatgagaaagagagagagaggcagagacacaggcagagggagaagcaggctccatgcagggagcccgatgtgggactcgatccagggtctccaggattaggctctgagccaaggcggcgctaaaccgctgagccaccccctagtacacttttttgtttctaaatatgtatttctctgtcaagctggctttttttaaagattttatttatttattcatgagagacacagagacacaggcacacaggcagacacacaggcagagagagaagcaggctccaagcaaggagcccgaggcaggactcaaacctgggaatcctgtatcacgccctgagccaaaggtagacactgaacccctcgctgagccacccaggcgtccctcaaactggctttattgttgatttctaattttactgcatatgtcaaaagtatatacacagatgacccctgacttatgatttttttgactttatgatggtacaaaagcaatacgcattctgtagaacctgtactttaaattttcatcttttctggtttagtgaaatgtgataggatactcttttgtgatgctggacagtggtcatgactatagttggctagttggtaacaagggcaaatgaccaatcacaccattctgtacctgttcaacaattctgtttttcactttcaatatcgtattcagtaaattacgagatattcaacattttaagtgcattttcgatttatgagagtttatcaggatataaccccatgataggctgaggaagatctgtagtttgtgttactgatgctctggaatttctaatactttatggcttaatatatggttagtttttataatactcccatgtgtgcttgaaaaaattacatattcttggttgaatacaaggtttttttctctcaatatagctatttgatcaaccttgctaatggtatcattcaacctatttttttcctcccgtctgtcactttttctatcagtttcttaatgagatgttttaaagtctccaatgtggctacagattggtcaactttccccccaactctatcaattttgctttatatagaagtttgctaggtatatataagttcatgactgctgtatgtcttggcagactgtcccttttaaatgtccctcatttacattctactttgttttttttggataaaaaaaataattgtaattattatccaagtatcttttggttagtatttgcttgatataccttttcccatcctttcatttttagtcattcagtactacttactgtgtttgaaaacatatgacaagttttactttctttttaatacaagtttgtatctattagtaagtttaaagtgtaaccaagttacatttactgtgacatttaacctggaaacatagctttttctgagctacatggtgtcccttcaaggtgaattagaatcagagtccttaaatttacttcctgcgtaacaagctctatgataggcagttggcacttttaagtccactgaattaagaggaagctggttaagtgccaccttagccgggtcagttagatctacctgggtccagtggttgttgggtggtttaaggattataaagtctccagaagcaaaaattgcatttaatatttgctgaagccagggtgaattgtatcggagtcaatggaaagtacactgtggatgtacttcccaatgaccaaaaattctttcctggaatgtggagctggataggaaagcaagtacaactggtttggaagagtcatctggactcaattcatttagcagaaggctattggctcctatcccagcaattcagcttctattcagggttccaacacaaaccagctcaaatacagtactatactctgtaacagggcagattctaatctctacactaaaccactgaattagctattcatcaatgggtagcattcaattatatctcataatataaacagataaattaaagagatttcttttattctagtttttaaaagtggttgaaaataattcagtaattatttgcaggtaaaagagctaactttacttttaggttctcctagtgagtttaaaataaataataaataaaatttcagttgtgactaaagaatgggttcttttaaaaagctgctagtgtttaaggtaaattatacataaagatggctcaatttacaaaatcacgacctacttggaatttttttatccactgaaagcaagaaatccgtctttagtatcttagagaaacaaaaatatttaggggcgcctggctagtttagtcagaagaacgtgactcttgatcttggggttgtgagtttgagcccactcctggcagagagattacttaagaaaaaaatatttaggggctcctgggtggcttggcggtttagcgcctgcctttggatcctggagtcccgggattgagtcccacgttgggctccctgcatggagcctgcttctccctctgcctgtgtctctgcctctctctgtgtctctcatgaataaataaataaaatattaaaaaaaaatagaatcttaaaaaaaattaaaaaaaatatttataacattacttaagagtgaaagaaaaaaagacctaattctacaaagtaaaaaaaaaaaaaaaaaaaaaaaaattttaactaaaaaaacttagtagtagactaagcattatctcctcttcctgagacccccatcaatatgaaagtaaaaatagaaaggggctatcagaagaaaggagacctcaaaaaaaattccaggaagatgcaaagtgataaatgagggttgaaagaccaagaaaagcaaagcaaagtcagctcaacttccagactctggagaggttccaggatagcatatggcagggacatggagtagaagtgagaaggggtctagaaagttgaatgtctacataccaaatagctatccccacacatggagaatggcctggagccaagcatatatctagacaactctgagggctctaatcccaaacagaaaaatagaaacactgggaagaactactgtagtgtatataagtactccccgccacccccgccctccgccccagtaaagtccacctattgtggcattctttcagctggttcctggaaaaacagccccacttccctccacatcactctttaccccacccacttaacatagggctcccattcagtgctgctactgcctcagtctaactgggacagaatgaccatgggatcacctgacatcccaaagggcatcaccaaaaggaaggaaagatcaaaacaaacaaatgaaaactagctctgatttaaaaaaaaaaaaaaaaaaaaagaacagaagaaaacttaaggaagattagttattaccctcatagctttgagaggctatggcatcctaaaaaaagaacaaaatgtatgtaaacgcaaccaagaatgaaaatagaattgtagaacttagaaatgtgactgctgatataacacattcattagacacttcctgtgtgacaagctctatgataggcagttggcacttttaagttcactgaattaagaggaagctggttaagtgccaccttagcagggtcagttaaatctacctgggtccagtggttgttgggtggtttaaggattatagaatctccagaagcaaaaattgcatttaatatttgctgaaggctattggctcctatcccagcaattcagcttctattcagggttccaacacaaaccagctcaaatacagtactatactctgtaacagggcagattctggagaatgagataatgaaagtataaggcaagaaataagacattacttattgtgtggtttttcttagggaatttcttaaggaatgtttcttttctaagtcttccagtcctttttatttttaaaccatggaccacacaaaaatattatcttgatacagttttagaactcaggggaaaaggttatctttaaaaagaaacattcttagatggacaggtctatgcccatatatttgactcactgtcttaaattccttccataacaaccaacacacatggaacttaaaatcttggcagatgactgggccagtaagaatggaatgaagagaaaagcatcaagaacacaggaaacctatgaagaaagtaaaggaatcttttaccttaggctctgatactccctggaattgcccctgactcacacacacaaaagagttctactaaactgcatgcacggagcagggactgaatagtcaggagaactctaattctgtggtgtatgggaatgaaggccctgcaagactgatcagtttataaggagtaaggttggcaagctagtggagtagggatgagcgctgaggcagatgagctgtggaaaaacaaagagaggtgtaaagaaaagactgtcggggcagcctgggtggctcagcggtttagcgccaccctcagcccggggtgtgatcctggagacccgggattgagtcccacatggctccctgcatggagcctacttctccctctgcctgtgtgtctctgcctctctctctgtgtctctcatgaataaataaataaaatcttagaaaaaaaaataaaaagactgtccctgaagaaaagattaatcattagaagtgtttattttagttgcaattactaagcaaactcagacttcagtctaagaatgagcactcagaggaagtcaaatacatgaaaagatacagttcaaaacaagggaaccaatctgataattcaagcaaccgtcattacaagaaaaactgaattcttatttagtaagaccaaagaagacgttacagttctaaaataacggcaggctgtcacaaatatggagcaatgcgaaaacagaaaagaattcctaaatagcattaccattattattattattattattattattattattactactactactactactacaaaccagtaactccagagaaggcaaatgaatagctaattagatacggcagaaaagtagagattttagaggccaaaacttgaagaattctcccagcacacaaagtaaaaatgtggagatcaaaattataagaaaggattaagaaatacaatattacgtcaaagtttcagcagtagaaaataaaactgacgaaggtgggaaaattgaagaaagaaagaaggaaagcttctgaagctaaactatgagccttcctatcagaagagctcaccaagcatgaggcagactccagtgattcctgagttttaacacagataaaaattttcatgcatttacacaagggaaaaataatttgataccagacttttcctcaataacaccaaatgattgaagtcaacagttttttttttttttaattttttacttatttatgatagtcacagagagagagagagaggcagagacataggcagagggagaagcaggctccatgcaccaggagcctgatgtgggatttgatcccgggtctccagaatcgcgccctgggccaaaggcaggcgccaaaccgctgcgccacccagggatcccaagtcaacagttctaaggacaaagagtactattcaagaagtctataatcagccaaaccagttgtgtgtgaaacattttttcaaaacatgtaataacacatactttacttaaaagtaattacccgggcagccccggtggcgcagcggtttagtgccgcatgcagcctggggtgtgatcctggagacccgggatcgagtcacacttcgggtttcctgcatggggcctgcttctccctctgcctgtgtctctgcctctctctctctctctctctgaatgaataaataaataaatcttagaaaaaaaaatagtaattacccagtatagtcaaccagtaataaatgacgaaaaacagaagaaagggaatacatgaagggggaaaaattcactgtcttaaaatttaaataattattttttaaagcagtattttcttttttttccgcttttcttttaaaaagattttacttatttatttgagagaggttgagagagagagagagaaagcaggcacacacatacataagcaggggaaagggcagagggagagggagcagcagattccctgttgagcagggagcctgatgtgggtgggacttgattccaggatcccagacaatgacctgagctgaaggtagatgcttaactactgagccacccaggcaccctgatactgttttcagtatcatacatggtaactttttgtattttgaagaatggtatcttaataataatgataatctatacctacatagttacaaatttaaacacagtgagagttgtgcaataggggatattgtttttattttttacactgtgtgcatgtagactattttgtttgcttggacaaataaatacctgttcaaatatgctatttaaaagggacttctagtttctggtctagtatatagggagcttagaagttgctactctgtcttaacagcaacaaagaatctgaaccgaaaaattaacaactcttctaagatttttttaaaaaagaatttatttatttatttatttatttatagggagacaaatatttatttttttatttttattttatttttaaaaagattttgtttatttattcatagagacacagagagtgaggcagagggagaagcaggctccctataggaagcccgagtgggactcgatcctgggtctccaggatcacaccccaggctgcaggtggtgccaaactgctgagccaccagggctgccccgaatttatttatttatttgagagagagtgcatatgcatgagcagggggaggggtagaaggagcaggagagaaagagaaagagtgagaatcccaagcagagtgggtggagtgtggagcctgacacagggctcgatctcatggcctgagatgatctgagctgaaatcaagagttggatgcttaaatgactgggtgagccatccagatgctcctcttcttagattttgtgcaaaagtgaatagggcaaaccactgcctccaaaattggagagacaggcaaatacagaaagtcacaacttaatggagcagaaatcatcaagggaaccagtggaggcgggagggaatggggtaggaaaacctaaactgtcttgctagaggcttagtggacaagtctaagaatcaaaactttggtggggtggtggacacaccacatttctgtgtttttacctccaggtacctcccctgtcctgcttctggggaaaggaaaaaaagagccattatcaaatactctagagcattctgctctaaaagcttgccttcaagtttttttttttttttttttaagattttatttattcatgagaggcacacagagagagacagagacacaggcagagggagaagttggctccatgcagggagcctgacctgggactccatcccgggtctccaggatcacgccctgggctgaaggtggtgctaaaccgctgggccaccagggctgccccaagagaaagtattttacgagagcctaacctactggggttttgtcagagcctagccaatggggaggaagggtaataaccaattctagcaccttccagccatcctctcccacctaagataagggtggagaggagatgtgaagaagagctggaatgacagaaaagccacttgtgaagtttacagcccagaggcacagatcactaaaagacacagacctaatcataggactatatactgcttcccttctttgcacacctaatcactgtattactaaagtcctgtttatcagacttcctttcatctagtacatcgatgttcagttttcaacaaaaaatttcaaggcatactaaaaggaaaagacaaaacaagcattagagccagtctgaaatatggcaggaatgctggaattaataagccatgaatataaaacaactatgattagtatgttaagggttctaatggaaaaggaaccaatggatactgtgaagagaaacacggaaattctaagaatggatcaaaaagtaatgctagagcctgggtggctcagtggttaagtgtctgcctttggctcagggcaagattctggagtctcgggatcaggtctcacattgggctccctgcatggagcctgcttctaacctctgcctccctagctctctgagtctctcatgaataaatgcataaaatctaaaaaaaaaaaaaaaaaaaaaaagctacagttaacagaaatgaagaatgcctttgatcagctcattcctcaactgaggaaagaatccttgaacttgaggatacatcaacagaatcttccaaaactgaaaagaaatttaaaaataacctgaaaaacaaaaacaaaatatccaacaactgtgacaactataaaaggtgtaacactgcataatggcaatactggaaagaaagacaaagaaatagaagcaatatctaaagcagtaacaactaagattttcctccaaattaatgtcagatacaaagcttagatccaggaagcttaaacaacaccaagcaggataaatatacaaaaaaactacatgcagacatgtcatattcgaagtgtagaaaattaaagataaggaaacaatgtgttgagaagaaaaacaatcaacctagatttctgcagcctgcaaaattatccttttttttttttttaagattttatttatttattcatgagagagacagagagagagagagagagagagagagaggcagagagacaggcagagggagaagtgggctccatgcagggagcctgatgcgggacttgatccgggtctccaggatcaggccctgggctgaaggtagcgctaaaccgctgagcccctgggctgccccaaaattatcctttaaaagtgaaggagaaagactttctttttatatatatatattttttattattattttttatttatgatagtcacagagagagagagagagaggcagagacataggcagagggagaagcaggctccatgcacccggagcccgatgggactcgatcccgggtctctaggatcgcgccctgggccaaaggcaggcgccaaaccgctgcgccacccagggatccccgagaaagactttcttaaaaaaaaaaaaaaaaattgatggaatttgttgccagtagacttggcttgaaaaaaaaatgttaaaataagttctttagggaaaaggaaaatgataataggtcagaaagacaggtttatgtaaaaaagagtgctagagaaagaataaggaaaaataaaaacttttatttttcttaattgatctaacagataatagtttaaaaaataatagcaactctatattcaacttatatgtacataaacttatgcataaatgaaatgaatgatagaaatgatagaagggatggaggaataaggactattttgttattaaaaggtacttacattagttgtacatatatatattgcaatcttacaaaaaaatcacttctaaaaaaaaaaaaagcaaaaactgatgttaggaaaggagagaaatggaatcatataaagtactcaactgaaagcaaaagggcagaaaaaagagtggaagacaaaaatacgaacaaagaacaagagcacaccaaaatagaaaatggtatcaaacatggaagcgattttttaaaaaaagattttatctatttattattcacaagagacacagagagagagagagggagaagacacaggcagagggagaagctggctccacgcagggagcccaatgtgtgtaggacttgatcccgggactccagaatcttgccctgagctgaaggcagacgctcaaccgctgagccacccaggtgtcccaccatggtagctattaattcaagtatatcaataatcactttgagggacgcctgggtggctcagcggttgagcgcctgccttcggctcagggagtgatcctggagtcccgggatcgagtcccacatcgggctccctgtgaggagcctgcttctccctctgtctctgcctctctgtgtctctcatgaatgaataaataaaatctttaaaaaaaatcactttgaacatcaatggtctacatataccaaataaaagactgtcagagtctatcagaaaatgagagccaactaatacgttgtctccaaggaaactcactttaaatataaaaacagatacagacggaaaagaaagggatggagaaagacattccatgccaacacaaaccaaaagaaagcataaatagctatattaacttcagaataaacagatttcagagcaaataaaattatccgagagaaaggatattacatagtgctacatcagagcattacataatgataaaatgatcaattctccaagaagacataataatcctaatgtgtatgcaccaaacaaaaatgtatccaaattgtatccaaatatgtgaggcaaaatctgataggactacaagaagcaaataaatccattactgttgaagacttcaacaacttttattggaaatggacagttccagcaggcagaaaagaaatcagatctaagtgatatctataggttacttcatccaacaacagaatacacgttcttctcaaactcacatggtacattcagactacattctacaccataaaacatacctatttaaaaatatagaaaaaaatatagaaatcatataacatatgttctcagatcacaatgaaacaaaactagaaatcaatcaggaaaagacagaaaatccaacatacttgggagattaaacaacatacttgtaaataacacataggtcaaaaaagaaatctcaagagaaatttaaaaataccctgaactaaataaacataaaaacactacttaccaaaatttgtgaaatgcagtgagaatagtgcttcaacagaaatttataacactgaatacaaatattaggtaagaagaaagatctaaaatcaatcgtctaagcttccaacctaggaaactagaaaaagagagcaaattaaatccaaagaaattagaagaaaagaaataataaaagtaggacagaaatcaggggtgcctggatggctcagtcagttaagtatcttccttcagctcaggtcatgatctcagggtcagtgggatggagcctgcattgggctctctgttcagtaggcagtctgcttccccttctccctcccctcacccctgctcatgtttgctttctctctctcaaataaataaataaataaaatcttttaaaaaccccacaaaaatcaatgaatttcaaaacagaaaaatcaacaaaactaaaagatggttctttgaaaagataaataaaatgtttcttccaggttaaggaaaaaatgcagacacaaattactaatatcagaaatgaaagagaggccatcactacagatcccacgaacatcaaaaggatagaaaaggaacactatgaatcaatgattactatgtttaccaattcaataacctagatgaaatggaccaattccttgaaaaacacaatctgctaaaaactcaaaaatacacaatctaaaagaggactatgtctattacagaaattgaatcaataattaataatcttccaaaacagaaagcaccaggtccaaatgtgttaactggtgaattctaccaaacatttaagaagaaatcataccaattctctacagtcacttccagaagatagaagcagaggcaactattcttattctatgaggtcagcattaccccaataccaaaaccagacagacttgcaagaaagctacagataacatctctcatgaacacagatgcaaaaacctcaacagaatattagcaaaccaaatccaacaatatgtaaaaaaagaattgtaaatcaggacaaaacgggattttctcagatatgcaaaactagttcatcatttgaaaatccattaatgtaatctaccacatcaacaggctaaaaacaaaaaatcaagattctatcaatagatgcataaaaagcatttgaccagatctgacacacattattgatgaaaaaatgctcagtaaaatcagaatagaggggaacctcctcaaacttgataaagaatatctataaaaatcctacagccaacttcatacttgatgatgagaaactttcaagttttcccactaaggtcaagtacaaggcaagtgcctcttatcacttcttttaatcatactggaagttctagcaaatgcagtaagacaagaaaaggaaataaaaggtatacagattgaatgaagaaataaaaccctttgtttgcagatgacattgagaaatgtcaaaaaaaagaaatggcaaaaaaaagtacttgtggaattagtaagtgattatagatagcaacattacaggatacaaggtacaaaagccaactgtttccctaggtatcagcaatgaaaatttgaaataaaaaacactatactatttatattagcactcctaagaatgaaatacttatgcataaatctaacaaaatataatatctaaacgaaaactataaagctctatgaaagaactcaaagaactaaataaatggggagacagatactcaatattcatgagtaggaaaactcaatgttgtcgagatgtcagttcttcccaatttgatctgtagattcaatgcaatcccaatcaaaatcccacaagcttttgtggatatcaacaaagggattccaaagttcatattgagaggcaaaagattcagaatagccaaactatactgaagtcaaataacaaaaggctgtcactacttaaccttaaaacttatgataaaactacagtgaacaagatggtgtggttttgacaaaagaagagacaaatatattaaaggaacagaatacagagcccagaaatagacctctataaatatggtcatctatttttgacaatgaccaaggcaatacgatggtaagaagagtattttcaacaaattgcaaaggcataatccataaaataaagaactgatacgctggatttcattaaaatgaaaaacttctgctctgtgaaagacagtgttaagagaatcagaacacaagccacagactgagaaacacatatctgataaaagaccattatccaaataacaaagaactctcaagactcaacaatgagaatatgaataccctgatttaaaaaatgggaaaagggatccccgggtggcacagcggtttggcgcctgcctttggcccggggcgtgatcctggaagaccctggatcgactcccacatcgggctccctgcatggagcctgcttctccctctccctctgcctgtgtctctgcctctctctctctctctctctctctctctgtgtgactatcataaataaataaaaaattatttaaaaaaataaaaataaaaataaaaaatgggaaaagatctgaaccaacacctcaccgatgaagatatacagaaggccaattagcatataaaaagatgatcaacctcatgtgttattatggaatttcaaattaaaacaaggaaatattattatacccctattaaatggtgaaaatgcagaacactgacaacatcaaatgctgaggaggtggtggaacaagaggacttctcattcactgtcactgttgacagacactttggaagatattttgggggtttcttacaaagctaaacatactctaccatacaatccatcaatcacactccttcgtatttacccaaaggagtttaaaactaatgtccacacaaaacctgcatacaacttttatagcagctttaatcataattacccaaactagaagcaagtaaggtgtccttcaataggtgaatggataaattatggtacatctagacaatagatcattcagtgctaaaaagaaatgagttatcaagccttgaaaagacatgagggaatctgaaacacatactactaggtgaaagaagccaatctgaaaaagccacatactgtatggttccaactatatgacattctggaaaaggcaaaacgatggagacaggaaaaagatcagtggttgccagaggattaggggagaagaaaggatgaacaggcaccacacagaggatttttagtagagtgaaaccattttgtatgatattgtaatagtagacacatgacattatacatttattgaaatccacagaatatacaagagtgaaccctgatatgatctatggatttggggtgataatgatgtgtcaatataggaccagcaatttaacaaatgagccattcaggtgcagggtgctgatggttggggatatcgcacgtgtgcagagatatgggttatatgggaactctgtactttctactcaattttgctgtgaacctaaaactgctctacaaaattaaatcttaggggatccctaggtggctggtggtttagcgcctgcctttggcccagggcgtggtcctggggtcttgggattgagtcccacatcggggtccctgcatggagcctgcttttccttctgcctgtgtctctgcccctctttctctgtctctcgtgaataaataaataaaatctgaaaaaaaattaaatcttaggggcacctgggtggcacagccagttaagcatctgactcttggtttgggctcaggtcgtgatctgaagctcatgagatcgagccctgtgttgggctcctgaatgcagtatgcttgacattctctctctcctcctccctcttgaccacctgtctccccggttctctcttaaacaaagagatgaataaataaaggggaaaaattaaatctattttaaaaagaaagtaaccactgcattaaagagacagtatatgtaatttccatgtcgctagagaaaataaaggaagaacaatcaatatagtaaaatgtagactagtcataagaaaagcagataagaataacacagcataaaagatgacaagaatacactttttaaaaattatcataattagggatgcctggctggttcagtcggtatagcatgccactcctgaccttggccctatgttgggtgtacagattacttaaaaatagaatcttaagtgataccagcaaaatggttacccgcatcaccatttaaaaagcagaaaaggctaaaattcagagtaaaaagaataaacgggacaaagaaggtaattttatgatgatatggtatgatccattatggaaataaaactatcatcattcttttttttaaagactgtatttgagagatagagcaagtgagagagagagtgtgtgagcatgggcagagggagagggagaagcagactccctgctgaaggaggctcggattccaggaccctgagattacgacccaagttgaaggcagaagcttaactctttaggcgaccgaacaatcattctttatatgctgaattacataaacagataaagaaaaatacaaagcaaaatataaggagaaacaaacaaaaatcacaattacaatataacatctcagaatttcaaaacttaaacctatagaataaagagtctgtatgtatgaacaaagactatatataatctttgtgtataaaatgaaacatttatacaaacttaaatacacttggcaaaaaatattttcttaatgaattccctgagagaatcttataggccacttcttccatcactttcatcataattactcaatcatctgagactgcagttttgatttcttttggattcaggagttatttcaaggtgtttattttttattttttaaagattttatttatttattcatagagacacagagagagaatgagaggcagagacacaggcagagggagaagcaggctccatgcagagagcccgacgtgggactcaatccagggtctccaggatcacgccctgggctgcaggcagcactaaactgctgcaccaccggggctgccctgtttcaaggtgtttaatgtttcccaaattaaatttggaaatcagcagagtaagatacaattttcatgtctcaaagtggctatgataaaaaacaaaaataccttgcaaatatgtagaagaaatttgcattttcatggtgctgggctgtagacaggtactcttcctagagagcaactggataattaaaaacaaaacttaaatatattaccaacaattctgcctcaagaaattgatccttaaggaataactgggcagtgctcacttcggcagcacatatactaagaaataactgggcaaataccaaaaaataaaaaacaacagagatatccttctcaatgttgcctggaataatgaaaaattagcatcgaactaaatcttcaacaaaaaatagtcacaatggcatcccgggtggctcagcagtttagcaccgccttcagcccagggtgcgatcctagagacctgggatggagtcccacgtcgggctccctgcatggagcctgcttctccctctgcctgtgtctctgcctctctctctctgtgtctctctcatgaataaataaaatcttaaaaaaaaaagtcacaagtatggcgtatttatacctggactcgaggtctttcaaaataatcactcacatacatgcctataaaagacatcacaaaaggatgtctttccacaatataataagccaatgaaatggttaaattcctatattattttaaatatatatttatatatatttatatgtatgtttttatatatatatatttaaaggcatgaaattaccaaaatgttaacaaaggttatcttttttttttaacaaaggttatctttaggtgatggcaatataaatgaattttgttgctgagtattggttatttcttaaggtttcagtaccagatacagatcctgtgataacacaaatatagaaaagtgctgggatccctgggtggcgcagcggtttagcgcctgcctttggcccagggcgcgatcctggagacccgggatcgaatcccacatcaggctcccggtgcatggagcctgcttctccctctgcctgtgtctctgcctctctctctctcattctgtgactatcataaataaataaaaattaaaaaaaaaaaattaaaaaaaaaaaaaaaaaaaagaaaagtgctaatggcagaatgtaggtggcaggcgtatgtggggtatttacaatataattctgttgggatccctggatggcgcagcggtttagcgcctgcctttggtccagggcgtgatcctggagaccccggatcaggtcccacgtcgggctcccagtgcatggagcctgcttctccctctgcctatgtctctgcctctctctctctgtgtgactatcataaaataaatttaaaaaaaaaattaaaaaaaaaataaatctttaaaaaaaaaataattctgttaataagttagagtttgaaaatttttataatgtgggaaaaaacttcaaccctgaaaacttggagaaaaaaaattattttagaatctaaaaatgagggactcctgagtggctcagtagttgagcatctgcctttggctcaggttgtgatccaggggtcttggatggagtcccacatcaggctcactgcagggaacctcttctctttgcctgtgcctctctctatgtgtctctcatgaataaataaaatcttaaaaaaaaaaaatctaaaaataaggtactctcatttccatatcaatttttctgagcttcacaaaatatgctacagaatacactgcaaaatgggaggagtagctttttttttcaattatgtgagcattttttttaaaaagcaacaaaaaattaaatggacccagtgccaaaaatataaatctagtttctttcctgtgtaaataaataaataaataaataaataaataaataaataaatacagtgagactgtccattgacagatgaacaaaatgtggtatatcaaaaaaaaaaaaaaaaaaagtaacctaaaaggctcatacaacagttcattaacctgactagcatcctctggatgaagataataggatggaataggagtggagagatataagagcccagggcttttggaaacagtgttgtgtggtcaggtcatgatccactgtgtgatttcaggacaaattattcctcttttctaataacaacaacaacaacaacaacaacaacgataatggctagtatttgagctcttactaaaatgtctacctacaaagcaagtattatcatggttcttatgttctagataagaaaaccaatgcttagagatgataaataatttgccaataccatgctgttctgttaagcagcagcactaggatttgaatgtaggtgactaattctaaagccagcacacgtaccaaatgtattaatgccctcttcatccctgctgctgagaaaataaattaagacaccttctggagggcaggcaagcttatataaatggaaccttcaattgttttttgaatttataattactgaaggggtattacataaatctgcattctagactgaaaattctggaaaataagtgtgaaggaccagctttaaaaaggttttcttaacaataatctaaccttcattttattttattttattttatttttgtttttttaaagatttatttatttattcagagagagagagaggcagagacacaggcaaagggagaagcaggctccatgcagggagcccgacgtgggactcgatcctgggtctccaggatcacaccccaggctgcaggcggcgccaagccactgcgccaccggggctgccctctaaccttcattttaaaggcagaattggcaatttcagtttgagatgacaaaaaaattcaatattgttaaatatcaccataaaggcaatcttgctctgagtatttactatttcatgttctcaagtggcctagcagatataaacagtttatttgaaagcaccgagcaactacaattacatttctgaccctcaatctgctgctaactggtaccataaagtttttattttagctatactgataggtatatacagtggttttctcattgttggatggcattaaaagtaatttttaaaaactagacattaagaaattactcacttaaataacataaaagttagtagcttttatttattttttatttttttaaataaatttttatttatttacgatagtcacacacagagagagagagagagagagagagaggcagagacacaggcagagggacaagcaggctccatgcaccgggagcccgacgtgggattcgatcccgggtctccaggatcgtgccctgggccaaaggcaggcgccaaaccgctgcgccacccagggatccctactttcataaatatatattcaaaagaaagagaaaaacccaatggcttgaatggtatagatgtttagctctgcttgaccaaaagtgcaggtttatttatatttatttttaaattttccttttttttttttttttaattttacttatttattcatgagagacacacagagagaggcagagacagacacaaggagaagcaggttctccgcggggaggctgatgtgggacttgatccctgacctggaatcacgccatgaactgaaggcagacgctcaactgctgagccacccaggtgtcccaaaagtgcaggtttaaaccagataacttcctgatgtccttttcaacaacgtgattgtctgggcctataaaaataatttctacctcacatcatagtccccatatagacaggcacactccctcgggtttctcaagcctgtgcatcttctcggagatgtcctcattcagttttgcacccagacctctgcagctcacacagccataaatagctgatcgtctttcctttggctctcataaatctcagtgaaagcatgtcacagaggaactcttggttgaaaacgatactcttccctactttaagtgcctcactctccatactaaaaagcccttttgtgtgtttttatggcatactgtgaaaccaaaaccgtatctgttctgaggcctgacatggagccccatcagctctctcaatggacgggacaggctgttcagatggcattctagactgcccatggaggcccttaagtcactcctcaacccaccggccggagaggactgttcagtgtggcaagatctagctgagcaagaacagcaggtatggatgaaaaacagcatttcgttcggcatagatgtaaatgcatgggcctgctacttacagtatagattacatctgtttttttgaaactgttaatttcccatcctcaataccatgacatttcatcaccaataaaaggcaatcgccatacataaaagccattaggaaaaaccagcaggatggtctctttcctccagattcagtctctagggactgtgtcaataccatgatgatgaagcaggagaaacagcaagggggctactaggacgggtggagcaaagtgagcaagagagagaagtgagaagtgaggtcccagaggaagccagatcataggccattctaagggcttcagcttacacagtgacatgatgtactgcaacctggcttcttttaacaggatcatttcacctgctgtgttgaaaacagaccgaagaagtaagaactaggggagagatgacagtgacatggaccaaggtggtaataacagagattggtaagaagtggttggcttctggatataaatgcattctgaaggtaaagtcaacaggattggctggtaaactaaacactgggtgtgagaaatgaaagaaattaaagatgactcctagttttttgggttaagcacctaaaagtaaggagttacacttatggagctggggaagactgctgggggagcaagtttgagagaaggtactggaatcacaggtttagctttatatatattaagtttcagctgccagtctgagaaccaaatagaaataccaagtaggcaggttaaggaaagctctggttgaggatgaaagtgcatctacctacctaccgactaaccatctcccatattcaaaaccttgagactgagccggatcaccaaggcggagatggaagacagacaaggaaagaaatgaaaaaggacaactctaggatattccaaccaaaacagcaaagacactcagatgcaggagaaaaagtcattcaagatttctattcctgggcagccccggtggcgcagcggtttggcgccgcctgcagctcagggcgtgatcctggagaccagggatcgagtcccacatcaggctccctgcatggagcctgcccctccctctgcctgtgtctctgcctctctctctctagctgtgtctctatgaataaataaataaataaaccttaaaaaaaaaaaaaagatttctattccaacagtgttctgctcctagcctttgattcttcctgctaaggccccagtcgttgtggataagccgtctctgcagcgccttgtctgaattcatgtctcagagaaactgagttagtctggtttcaggttttgtgagacagcagtaaataactctctttctttttcttttctcttttcttttcttttcttccctcccttccttccttccttcttctttcctttctatataacagtttctaaagtcataattgtctgcataaccaacagaaagagttcacataaatatatccaacagcaatattcttagttctcaggctgatgagcaaaactgatgtttttttcatggatcacttctactcatactccattaaagattaatctagtcatctggaaacagcaaactccatgtgaatcatccctttctcaactatcttatcttcagtaatcatttaattcaaatctagaagaaaaaaaaaaggaaacaatagcatagcaagatcaggttgcaaagctaaaaataagcttgcatcaaagactaaaacaaaaacctaactgaagctttgctgactaccaccagagagggcactttcttgcagaagacaatacagtacagaatttcagcaagtctagttttaatctttctgagcttaaatatattgcctttagaattccgtggaggattctggctatactgttaaacattttaagtactgacttttacaactgcttgatggcttcacatttctacccagattctggaaaaagtgatggagttataaccctccccccccatttagataaagcaaaatttcccataggcttcctagtccctcttccctccccaaaggtaatcattctaatcagtttagtggttttctttccagcctccattctaagtatttgcatatatatgcacatacataaatatgttttaggacattttattttacacaaatcaatcatacttgccatttcatttcactaaatgcttctgatagctctatgtgttaggatatatacatttcctttattatttttaaactgttggataatatgtaatatgaatatttcacaactgaagtagtcattctcctactgaggggcactcggattatttccagtttttgctactacacattgaagctggcacaaacctcttgtacatgtttctttctgcctgtgaataagcatttctctacagatactcagaagtgaaaaatgctgggctcaaatatgaaccaaaaagcacaaaaagtcacaagatttggtcaaggtctccaagcctacggtaagagagaggggaggagaggtaggaaaacagaaaatgagagcaaagattaaagtcagaaaacccctgcctcctttttattttatatttgttatgagctcccagtgctctttcatgtcccatgtatgaggttactattgagaaacttacagtcaagttggatgatggctgatgggcaaaaacacatgaaatacagaaaaatgttcctagtggggagtatgagaaatttaaatttgtcccttttgggactcctgggtggctcagtggttgagcatctaccttcagctcagagtgtgatcccaagatctcagggatagtgtcccatgtcgggttcccacagggagcctgcttctccctctgtctgtctctctctcatgaataaataacaattacaatgggatggtgggggaagaacctatgtatcagccttgaaagtcatgaaagcttccataaaacgaaatgactgcactgaaaactcaaagaagtgtgctaggtggcaagggaacagggcaagctttctagttggagggaatcacatgatgtcacgtgtgtggtatgtcctgaaatggagagcacttgcaatgactggtgtacagtgtccaaaagcagtttagacatttaagtgatctctataccctacatggggctagaattcacaacctggggatcaagagtcacatgctcttccgattgagacagccaggcaccctgaaaacagtagactttttttttttttttttttttttaaagatttattagagagagagagcacaagacagtgggaggaggagcagatggagaaggacaaggcaaactccacgctgagtacagagcccaatgtcgggcttgatcccacgaccctgagatcatgacctgagtcaaaatcaagagttggatgattaaccatgtgagccacccaggcacccccagtatagacatttttaaggctcttagtacatgttgcctccttcatcatcttgggtagaaatagttttttaaaccttggctaatttggtagaagccaagataccagcttttttttagctggcatttatctgatgactagtgagatggaatatatatatttttttcatttatcattacctctccactaaaaagtgggaatacacaaggaagaactacttttcttcaatcattatctttctctctctattctgagtttgcaggtcaatgagcagtactacactttcaccaagatacccaagtcctagaaccttctcaactgtgaatccctctgccaggatgtcaaggctctccaccatgctgcactcataacctgttctttgcttctacatcatctgccatgttcaggacactagtcctaaccctaaccgagcctacagcaggagtctgacaaatagttaccaactaagcatgagtaattaagcaactgagatctggaggacaaaaggaactctctagaacattcaacagaggttttctacaagtgcgactgtctccaagggcattgtggagataatgcatgtttcttgttgtcatgatgactggagggcacaactggtacttagtaagatgggaccagaaatgctggacaaactgccataagaaagatggtctcactcaagaactatcctgtgtgaattttcaaactcctaccatacatttatgtcgggtgggaatcccgcttttaactctctgagcctagaatccaaatgacaaggttgagaactactccaatctaaacaatcatttgcaaatgtaggaggtcaggtagagaatggtacaagtataggccctactccatgcctataacctcatcaacacacacaatgaaggacatctacagaccaaaaatctactacacaaaagcaatacaaaccctcctactcagttcttaggttatatttcataacctatcttactatttctatgcctgaaagtggcccccagatagggtaaagaagggttatattaggtatactgttcctaagtaaaggaaactataacccaggtttacaaagaaaagtgattacctccttgctgatgccaattacttcctctttaaataaatatcgtcttgtcatttactaccaattcaaaacaacccagatccaatccctaaataatccaaattagcaccaagggctaattctaccccttagagtactcctccctaaaatcaacaggttcacactaaccagcttggaacacattgtcagactcctcaaagtattaacaatgaaagtaccagtgatgtgaaagtatcaatgatgcaaattcattcatactatcttataatataaaaaagcaaataatgttattagaaactaataacagtatcagaatattattaaaaaccagtatcttaagagtaaaagagatacaaataaaaggaaaaaaaccttgtaatgttaaatttgaagtggaaatattaatgtgaaatcgtgatttttctttttcaaaaagattttatttatttattcatgagagacacagaaggagacagagacacagagagagaggcgcagagacttaggcagagggagaagcaggctccatgcataactttatcgcattacagggcaaggaaggactcaaaagtatacagaaggctgcctgaaagggtacacgctgaccaaatctgagataattaaagagaataacgactgtaactgactataacacaatgaaaaaaaattaagatctatgaacccaggaggttatttaaaataagaagaaaagaggcacctgggtggctcagtgggttaagtgtccaactcttgatctcagctcaggtcttgatctcagggtggtgagtttaagccccatgctgggctctgcactgggcatggagcttactttaaaaacaaaataagaaaaacatgggaaggcaaggagcatgaaagaggaacaaggaaaagagctttctcttacagaagaatttcagctaattaaaaaaatatcagaaaatcattgtatttcagtctctactgtaaggatctatttggtaaggatcatcagaagatgctaatacgggttgaaagattgctgggagacaggatattcatatagtgtagaagcattactcaatagattatttaggtattctgctgcataggcagacatgcactgctacaatggagagatcagtcagtaacaacatgatcaaacattttatcaataatggctaggcaacctgacattatgcatctcctaatgttaaatattaggaagcatgcagcatcactgatgcagcaatctatcaaaaatgtctatcctaaagctaaacaagcctccagccctgtgctatttatttaatatgatggccattatccacaagcagctaaagagcacttaaaatgcagctatcataactgaggaaatgaatttaaaattttgatcttaactaacttaaagagccatagatagctagtggctactacactagacagtgcatatatataacttccgaaaagttctactggacagcactgctctaaaagaagttgttagaaatacgggataaggaaacaagttaaaggacacgaagaagaaacaaccaaagaaaatcagaatgtgagatattctattagaaaatgatcctggactttttaggtggggataagagattatagaattatgaattttcttaggtgtgacaatggcatgtggtaatgtagggaactggctttattctaaaaagatgcatgctaaaggacagaatttttttttaagattttatttatttattcatgagaggcacagaagagagagagagagagacagagacaggcagagggagaagcaggctccatgcagggagcctgacgtcagactcaatcccgggtctccaggatcacaccggggctgaaggtggcgctaaaccgctaagccaccagggctgccataaaggacagaatttagaggtgatatgtcataatatgtatgacttcttttcaaatggcttggcaaaaaaaaaaaaaagtatgtatagagatagagcaaaaagccaacagatatatctagaagaatatagtatttgtttcacttttaaaatttttttcttatatgtttgaaatgattaaaacactgaggaaaatagagccagccatggaattatggtaatatactgtcttctttgtgctttctggattttcattctgctaggaacataaatttttttaaataattttttttaaaaaagattttatttattcatatgggggggggggcagagacatagcagaggtagaagcaggctccatgcaggaagtctgatgtaggacttgatcccaggactctgggaccacaccccgagccaaaggtatatgctcaaccgctgaaccacccaggcatcccataaattatttttataatcaggaaaaatggtgagctatagtagtcaccggtttaatcaagtaatcaaactgctctgctaacaacatcagtaagtcctgcaaggagcacacaaaagccctcagattaagagtactgttcagtaatacttacactcaacatggggctctaactcacagcctcaagatcaagggccacatgttccacagactaggctagccaggtgccccctgggcactgctcagattatactgtttccatttttttttttttgttttttactgtttccatttttaaaaccactcatggagatttatagtctaaagtacctatatatttaaactaaaatgctaacacaaatatgtagtaacataacgttttgaatatgtcaaattcacaaagctgagagtatttactcagtaattttgcaaaagtcaaaatgatagtcctacaaattgtcaatcattttaaggtggactccagaagtaaccatggaagtaatccaggagtagccatctcccatttcgtaacagaggagaggtgccttcctctgaaaggaaagagaggcttccttgctctagggccagagttgaattacactcttggccacgtgagtgtagagcaaaagctgagcacgaggattagcaccatacgcctcagccaggcccttcactggaggtggtgtctatgccaaggtctcctttcatccctgaactgtaactgggaggaaaggccctttgcaagttctcagctgccagaaacaggagattcaatacggatttacttacgggcctctgccagcgatctgcaggactcattccgcccactaacagaaaacagcctcacacacgtttccacactaaaacgtggtatgctttctctgttcatcttacagatttgaagttatttgtttctaaggaaaaggctcttctcttgctatgtcttcttttctcttgatatttttgcacgtaagctttcttaggaggtcagaataaagacgtttccacatgcaaaaatatgtccatgttaggtaaacaaaaatttcctgatattttttcatcactgaaccacatttcctattacgttctttaaagggagatggggtggcatctgggtggcttagttgattaagcatccaactcttgattccagctcaggtcatcctctcagggtcatgagatagcagcctgcatcaggctcctgtgctgagtgtggagcctgcttaggattctctgtctccctctccctcgcctctgactctaaaacaaattctttaaaaggaattaactatcagaataagatattttaagagacatgatgcttcttgcattctataatgctgtgaccaaatgagctaaaaatacctccttccccaagtaaaaataaggactcggtagtacttaacaaaacacaatctgtcttaaggaaagtagaatccagcatatcattttacttcatagtttcctcctcaagatctgaatatagctgatgcataataagcatttacggttattttctgaccaactttttattttgaaaaggttcaaatatacagaaaaattctttgcctatttttgtccctatttttaagataaatctgtaggtgcacatagccatgcatataccttattattaataactcaaaatcatgtaatttaaagtttcttaaaaattaaatcctggaaattcagagaatagtctttttttttttttttagaagcaggctccatgccgggagcctgacgtgggactcgatcccgggactccaggatcgcgccccgggccaaaggcaggcgctaaaccgctgggccacccagggatccccccagagaatagtctttaaatgaaaactgcttttcaacatcttaggttgatttatggtctctcttgatttacaataatttatatatggatatatttcctcatattaacatttccattaaacagtgaaatgctgccaatattaaaaacctttatttgctttcacttatcatttagaagactgaaaaataaaaaactgtcttcttcaaagaggctgaagctcatcactttacagctaaaaataaagtaaaaatctgaaacacagctcatcaacctcactaagaacacattttggttgtttttttgttttgttttttacttttaaaaaaagatttatttattttagagagagggagagggagacaatctctagcagactccctgctgagcagagagcccaatgtggggctcaattccacgaccctgagatcatgacctgagccaaaaccaagagtcagacactcaatcgactgagccacccaggcccccctggttgtttttcatatggaccttttagtattactattgttgtttaaacccatatgcatgtattattttaacatttttgaaaaaaatttttgaaaaaaaaatttttaaaaattagttatctaggggtaccctaggtggctcaggtcatgatctcagggttgtgagactgagccccacttcaggctccacactggatctggagcctgcttaagattctcttgctcaccctcccctcctccccccacctcccaaccttgtgtgcctctttttctctaaaaaatattagctgcctatattaaaagaccagatctcacatgagactctagctttcaagattctcttgaaacatcagaaccatatcgggtcttgattgctacatgacaactaacagctaggcctgagtaggaattgccttgtgaccagggcaggctctccccatatggttagaactacatccactatcaactgcttgtccacttccctacatacaagcttataagctggaggacccctagccatgacattacttcccaccttttccccatcatattaatctgattaaaaatatttgtaatatattctgatacatattttgtgattaaactttgggattttaaaagaatcatgttatttctctaacaaattctgtgattccctatccccaccttttggacacaactgttcaggctgaggccaaaaaataaagatgaaaatacaatgtagtcacacagagcctttacgttttactccacttcaaatagagtcaaatacttatgacctaaaaagaaagggtgacaaagtagtatcttaaattattcccaaatagttacaggctttttaaatgttctacttgtgtataacaagagctgtgaaagactgcttctttgttagagacagttctgagattccatatggagctttctagtcgctaggacatatatattagagtacaactatttttttctttttttggcagagacagggaacacagagtacaagagttcgataagaagatatagatttttaaaaaaggttttatttatttatttgagagagagagggagagaaagagcaaggagggagacagagggagcgggagaaacagactccctgaccagggagcccaatgtggagctcaatctcaggaccccgagatcatgacctgagctgaagtcagaggtttaactgactgaaccacccaggggcccgagataaaaatggggcctctgggtggctcagtcagttaagagtcagactctcaatttcagctcaggtcaggatctcagggttgtgagactgagccctgcactgggctccctgctgcgtgtggagcctgcttatgattctcttcttccgccctccccacacccctgcccccggctcatgcatatgctttctcaaaaaaagacaatgatgatgatgatgatacagattttgaaaataaagtccactatagtatcttccacgctcttatctgaaaatgagatcatgaagggttataatagattcctgatgggatgatgtaagattaggaaagctagagataacaacaaacacctctccactcctaaggcaactgtgactcttgatattatactaaggcacctagacgctcaaaaaactcctaaatgaaggtgaattaaatcaaacgttctgtgacacttttacgttttgtatagtgtattaaaaacttgagatttttccctgtacaagaagtacagggaagtataagaagacctcattaaagaaatttctaagatcgtgagtttatatggcaaagcaacaggtggttaagagtcagaggagtagcagaaaaatgtggtatcatgagacaagtgaggaagtcagagaacaagctacacctttttttttaaagctgtacctatgtcatagattaatgatcaagctgcctacaaatactttatagttgggtatgctggaaatggctccatggacataggccttgtccagacatgaagcagcagacaaaaggaactggcatttggccacatattttcaattgtcaccacagactacacttctataaaagcagaaggcacccatctttaacatcctttttttttttaaatttattattttttaatttttatttatttatgatagtcacagagagagagagagaggcagagacataggcagagggagaagcaggctccatgcaccgggagcccgacgtgggattcgatcccgggtctccaggatcgcgccctgggccaaaggcaggcgccaaaccgctgcgccacccagggatccccatctttaacatccttgaagaggtcacagttgaaggtatgcacgtatctttctcccaattctgttttcagatgttttttatttttgtgataacgctcttggttcgctcaaggtgagaagagagatgaaacatcaacagaagacacaacagtttcagatccagtttctcttttttttctctgttagccaacagttttacctttcctattgaattagcaagaaagaatagctctgaaaactacacaaagaggtgcttttctttttgattacagagggtgtctcatggttggctcacacgagcctttgctgccctgggctggagatgcactgttaccaaagctcctggggggcctggggagagagccccagccctcccactcaatgggggtcactttaataggattctgaccataagcagctaaaaaacggaggccagtttccaaaagggagtattttagcccttgaaatgtgactgctaatgtttcaagtgctacagatttattggtttctgaaattcagccaacatgctgaaatgtttaagctgggttaaacaaagcttctgaatagattcagttgtctttttcttttttaaaaaagattttatgtatgtatgtatgtatgtatgtatttatgagagagagagggagagagagcgcgtgtgcgcgcgaccgcacacaaacacgcacaaacaggaggagcagtaggcagggggagagggagaaacagactcccagctgagcagggagcccgattccaagctcaatcccaggactctaagattataacctgagctgaaggtagacacttacctaactgagccacccaggcaccccaaacagactgagtttaatggtatcttggcccaacaacaaggccataacagctacttagtagttctattccattcatgtttatacagaatatttttctagtaataaatatatgttcaatgcagaagatgataatctctgagctaatccaaagataacctgaatgaacatcttggcagacattctttcaatgagcacagcatagaagcatgtgggtgctgagactagatgttctgggttgaaatcttaccttgagcacacttggttgggcacaatttgtttggacaaattacttaatcttgtgcgcttggctggctcaaacctgttttttttctcacccgcagaatgtagactgtgacagttccactatctcatagggtctggagaggatttaatgaggcaatatttgcaaaatgcttagaacagagcttgacacatagtagatgtgcaagcaatgttattttttccgcacaaatagacacacacatttcttttccactaaatggttttacatcataaatactgtttcatagtctgctttgaccacttaggaatgtgctgcaaacatgttcctgtgttagtaaatattttttttccccacatacacaggatcctcccagtaaagctgctgcagatgttctgaagcatgagcggccatacttttatagcacatgatatcttgacactctgaacacagcaagagaaataagaaatcagcaatcaaagcaaagttaaggcaaatgtcttcaaaatgtccaggagctaataatgtcacctggcagctgcacccatgggtcaggtcatctctgctgggaaagctgaatgtgagatgcaggtgagcagaaaccaggaggctgagaagagattagagaagcagctcatctacagaagacagcgactaggttccaggagccatactgcattcccaccgccgttccaggcactgtgagcaaggcctgtctgcaccctgtgacccaagtttccagtcctgcgtgcctggctggacagctactgtgacattgaactattcttcttcgtttaactgagacctgccggtatgtttactcctgacaactcaaaagggcctaccttgtatttatggggctgctctaagtagtcctgtcaataactgaaacacttgttttgttaagtacttgctgtgagttaagtacttgctgtgtgttaagcactggggactgaatagtgagcaaaaaggaatggtgcccaactacacagagacagacaattaaacaaagatgacagatatcatgatgctagaagtataaactgcaagggaaacacacagaaagagcagtgagtctacagggaggcatcacaaagactttatggaggaaggagccttcaggttgaaggacaaagttagccaggcatgccagatactgcagtgttcactcagtacacattcctgcccagtgtagaatctacaaccattagccttctcaagttagaatcttgatagagcaaaagtggactagatcagcatttccaaccaggccacctaagagtcttggcctcacttaacagggagggcttggtttctttggtgggtgggtgtctttcaatcctagaaatcttgagaatgaaatacagaaatatttaagagaatcaaaattgtaatatatttctacgttaggaaggaaaccagagatattttataattttgtaatgtgcaaaagaatttggcctagggcgcctggctggctcagtcggcagagcatgtgactcttgatctcaaggtcatgagtttgcgccccatgttgggcacagagattacttaaaaaaaaaaaaaaaaaaaaagaacttggcctattagagtataaccttggttttcaaaatataactgaataatttttttctgatttgtctttttaagttgaaaatctcagtttacatatgttatgggaatattttaagaatctaagattctaagactcacctcatttgtaaaaaatttttttaatatttatttacttaagtaatctctacacccaatgtagtgctcaaaactcaagaccctgagatcaagagtcgcatgttccactgggtgagccagtcaggcgcacgacgtttaatacgtgagattcacaggacttttttgttgaagagcttcataaggtttttattttttaagtcagacaactgaagttctttagaaagtacttctatttagctctataaatccaatttgaaacctctgaattaactggtctaagtactatccaaaagtgaccagtaaaatctcctacgtttatatagagaacaatcagagctgtaagcattatgaaaaaaattaactttttgaatgtgtactttacaaaagtcgtaccattttgttttttgtttttttttttaaagattttatttattcatgagagacacaaagagacagagagagagagagaggcagagacacaggcagagggagaagcaggctccatgcggggagcccaacatgggactcgatcctgggtctccaggatcacaccctgggccgagggcaaatactcaactgctgagccacccgggctgcccaagttgtatcattttgaaacctaaacaaacccctgaatagtgatttctgctcacaaaagctacccttaaaaaaaaaagaaaaatctttctatatcctctctgattccaagtcttatgctctgttgatggatgtggaattggaagaaccatcccctctattttattttgacagaagtactggaatgtttgttttcacaatgacatttcaccaatttttattgtttgtgcaaacatttgatttattctgtattgtattctagagttcacagacatttatcctctcaataatgctagaacaaagtacagggtgtggtatgactctcctctgacttgctcagagtcaggcagggtttaatttcaagctcaggaccctgtgcagacaggagggagtgcagatcctgaatatctgaggacaggatccaagcactatgccccatccccactcattctcactacctgtggaatggcatttccaggaaacaaaagagtgagcagggcaccctacacccttacttgcccctcactacatttctacttatcacctagttctctccatcttcactgcatgtgtataacccacagatgactcaactataacactcagaatccaacaacagtaatggcaactgatatatgctctcctgagacagatgccaaatccaaacatggtccacaaaggtatagtggtcagatgtgcccccacaactcctaaaaccaagtagcaagttttgcacaaagtctctgaactttttccctttctctgtattctaaaaccatcactccatttcaggtttaccaaccacatttctgaatctacaactgccacagaagctctgtcaaacatcacttttgctttaggtactgtggaacctacagcagccaaaaggcaaaaagattctggtgccctcaggcctagaaaggcagagtacagaatcacatctgcccgtccaggccaccctacccctatgcattccccattatctcaggtctgataagaacgggggacaccaattcttactactgtgagaaggccttctcacatcctctcggacagtatctatcactcccctacactctgatcatttccatttggggtaacccttcaggacttttactgttgcatcccttgctccacctgtcacagaagcatgtattcgttaatttctgttcaccgggcagcccgggtggctcagtggtttagcgcctgcctttggcccagggcatgatcctggagacctgggatagagtcccacatcaggctccctgcatggagcctgcttttccctctgcctgtgtctctgcacgcccccacccccaccccgtctctgtctcatgagtaaataaataaaatcttaaaaaaaaaaaatttctgttcacctagttgtgtactgtgcacatgcaaggaggatataaaccacaaaacatactttatgctctcagagattatagtctagttatggactccagataaatgataaaatgacagagttgcaagtcaacacaagcctgtaggagttcagagcgaggaaagaattccttacatattccatgggtaagattagtctcagggcacttcagcaagggctgaacccaaaagaaatataggagacttgttcttagtgctattttagatgtccttagcatcagttttcagttccctctggaacaaagaaatggatctaaaaagcactagccatatggccagggcaagttaatgggtgtgataaaacttacatcaccaagttaggagtcttaagtgaaataacataagcaaagcaaggaacagcatggcatcaccactgcaggctatggaggaatgttagttccttcctcctggctttgaactgcaatctgtatctcagtttgcccaaactgtaaactctagaagtaagggaactaaggtacttcttttgactacttactctagattatctagtaaaatatactgggtgtggtccaggaattcaggacatatatgctgaataacttgtgactaaataacaaagaacaaactattatctctcttttttttttctattatctctttaatggcattattagtaacactttctggctaacagaattgctgctttagccactgttgtatagccaggatccaggaagcagaggagaacaacagcctcttcctccatctcattaatgagaacaagccatatatcaatactgcctgtccctcttatttcttagggctgatgaactacttgttcttgatcttctgctacaggtaagagaggtaatgctgaaagagctccatggggaaatcacaaaagactatctggtatggttagatatggtcattaccagagccttcgccctacacagagtgcccaacaaacattaccaggtcacaacctgaccatccctttaatcaaggaagcacaaggtaactggtaaactccttctttctgtgatcacgagtatgcttactcagtgagtggtgataaggaactacacagacatgacagactcacgattacgaggtacagccatgcctttcctcctcagtgcgtacctcctcacagacttcacggactgctgccacgcttggctcctcctcaggctccatgcctcccccaggaacaatccatcggtctggatggcgactactgctcacaagcagcacctgaaagtcacaggggtcacgtgggtagttaaaaataaaagacactatttgtacaaactcagactctgggacctgagacccattttttgtttatacctctccaggtcacttcttgtagagtagcttttgcttctattggaaaaagtaagatagtccacctggtaaaagcagaaaggcatctgacctagtgtccagtacctctcccttccctcaggctctcagtcacttatcccatctaccctctcctttgttcctttctttaaagccctttgaacacagagttgacaaggactggggggaaaaaaagcccatgagcgctgtgagggctggccagaaggaaagaagtccttagccctaattggtaccatcgtcccaataccttctttcccagatcctcactcctggtccatcagatggctacagaccaaaaccacacaccacccctaagttctaagtgtgcactgagaacccaactccctcatctacatgaagtcaaaatcttcatcatgctttcagctgagataaaactagaactcttcttactagggaattttattaagaaaggagagaagaccaaccaaacacacatataaaatcctgatagagactatggtttactaatgcaaaattaaccagcatcctagttatggatgaaataaaatcctggaaggtctcagtttccttttccttacccctctctaggacagatgctaaacagttagctagacttctcctttggaggtagaattgggtgggcattacttccaaaatgaaaggaatcctctatagttccctacaccatccctttctgacaaagtctcaattttgaccctccatccctattccacctgtgcacttcacttctactccgcagtcatccttgttgcctgaaagaaaatgctatgtattctgtagtgcttgtagattccattactgacttctggtgaccttccttctggtcatcttccatctatcccttgaggcttctgcaactacatgagcccttggaaattctacctttttttcatccttaatcccttttcttcatgtcatgatagattctcttgatgttcctctataaagcctgtgatctgctgactcagggaaccatggaggaaggaaatctgtgaatccatatacagtcaccaatatacagtctatacctggctggctcagtcggtagagcctgtgactcttgatcttggggtcatgagtttgagctcactctgggggtagagtttactttaaaaaataatttaaaaaacaaaaataaataaaacagcaataaatccttatgaccttgaatttggtaagacatgctgaattcttagacatgacaccaaaaccatgaacaacaaaaattagataagttggacttcattaaaattagaatcttctgagcattaagaatatgaaaaagtgacttacagaatgggaggaaatatttgcaaatcatctgacaagggcctgctatccaaaatatgaatacataaaaatacatacaatgacaacaaaaagacaagcaacatttctccaaagaagatctacaaatagccaaggagcacatgaaaagatgctcaacctcattagtcactaggaaagtacaaagtaaaaccaacatgagatgtgactttacacccacaagaatggctatatttttaaaaataacaagaactggcaaggatgtagaaaaattggaacccttaaacacaagacaagaatgtcaaatagttcaggcactatggaaagtttgtggttcctcaagaactaaataaaaactaccataaggggtgcctgggtgtcagtcagctaagcattcaacccttgatgttggctcaggtcataatctcggggttgtgaaaatgagtcctgtgttaggctctatgctcagtggggagtctgcttgagattctctccctctcactctgcacccccatccctgctctcaaaaaaacaaacaaaaaccatatgacttagcaatcccactcctaggtatatgcccaaaagaactgaaaagaggtgcttaaatacttacacataaatgtacattattcactgtagccaaagtgtagaaacaaatgtctatcaatgaatgaatggataacaaaatgtggcatacacatgcacaggaagagtatttagccataaaaagaatgaagccgggatccctgggtggcgcagcggtttggcgcctgcctttggcccagggtgcgatcctggagacccgggatcaaatcccacatcgggctcccggtgcatggagcctgcttctccctctgcctgtgtctctgcctctctctctctctctctctgtgactatcataaataaaaaaaaaaaaaaaaaaaagaatgaagccctgatacacaacacacagctgatgaactttgaaaacattatgttaagtgaaagctagactcaaaaaatcacatattgtaagatcccaattatgttcaataggcagaatgggtcaatgcacagagacagaaagcaaactggtagttgccaggggttggggtgaagggaagaacagagagtaactgcttaatgagtataggattttgtttgggagtgatccaagtgttctgaaactacctaaaggttgctaaatgccactgaattagtggaactaaatgccactgacttgttcacttttaaatagttaatgtcatgttatgtgtacttccttccaataaaataaaactggttttaaaatcatagtaaatttttaaaagctaaatttaggagtcagtgctattactttctatctcagagcttacactccaagggagtggccttcccaaaagttatccttagtttcatataatattaaatcataaagctgaaataatatactatttccataaaagaagagggagatcattgccatactcctcccatcttataattgtggctaatcttacattttaaaaaattccttatcaagtacacttattgtgatgaacactgggtgttatatgtgtgatgaatcactaagttctattcctgaaaccaatgttatactatatgctaactagaatttaataaaaactttttaaaagttttttttttaagattttatttatttattcatgagagacacagaaagagagagagaccgagacacaggcagagggagaagcagaaaaactttcttatcaaaataaaaacaggggcacctgcccctcctcctgtttatgctctctcgctcactcccccaaataaataaaatcttaataaatatacaaataaaatccaaacataatcatgtttgttaatttacgttaaacagctttatttatttatttttaaatattttgtttatttattcatgagagacacagagagaggcagagacacaggagagggaggagaagcaagctccatgcaagaagcccgatgcgggactcgatcctgggaatccaggatcacgccttgagccaaaggcagacagacgttcaaccactgagctacccaggtgtctcagttaaacagctttaaaaaaaaaaaaagacttatttatttgacagagagagaaagagagcacacacaaataggcaaagcggcaggcagtgggagagggagaagcaggctccctgatgagcagagggctggatgcagaactccaggattccgggatgatgacctgagagaaaggcagacacttaacgaatgagccaccgaagtgcccctaagcacctttttaaaaaaagtcttccaaagactttctagataatggcatttaagtcctatcaatccaatctgcaaagaaaactcaagaagaaagagtagaaaaattggttaatctttcgttgatttgttatataaacaacacatagtctttcttcctagagttttcccacttggcaaagtgttacacagccattctaaacctaagcgtttgcttgaaaagctgactagggccatccaattaggttatagtccaaatgaaagggacaattgcaagccaaagcaaagaaaacctctaacataaagtataatttaatttctaaatttcaatccttgtgaaatattaattagtaaatctagaaagtgttattaccttgcacattcaaagcatggctatgtgaggtaatactacatataatagtgacactgggaaaaacaagcctcattactttgtagtcactcttcaaagcaaacaccattaccagtaaacagttctcctggcttagtttccttgacaacccactgaaaacttactgcaaaaaaaccaaaacattctttactttagctacaggctttactccttcctatcttagaaaacactaaatggtgtttctggtcagtaaattctgattctgaagcttgatttttaagtacagaattatctgaaaagaaattaaatgaaaaaattaaatgacaaaattaaacctataaatgacatactaaggaaaaaaaaaacaatttgttatttattcaacattcattaagcatcattataaaccaggaatggcagttgcagcttaaaacctctgcaattttaaggcagttcaaagtaagggactggacaaccaggtatcacacctttcatgaaactgttatcaccaagacaggtgattatcagtgcagagatggataaatgtacctagagaacacaccatatccaactcctggatttatggtacaggtggtcctatagagcagggagagatcaacaggtagggctgggggataggttgttatccacatggacacaaaggaaaatccttatattgattagggacacaaatatgcaatgaaagactaaagaaatctatgggaatgataaacctaatgggggaagagttacataaagggcttacttaagcttggaatagtaatgttttatttcttaaggttttaaaaattgctttaaaaatgcttaatacaaattttcctttttcttttttaaaagattttatttatttattcataagagacacacagagagagaggcagagggagagacggaggcagagggagaagcaggctccatgcaaggagcccgatgtgggactggatcctggatcctgggatcacgccctgggccgaaggcagatgctgaactgctgagccacccaggcgtccccaaattttcaaaagaatataaaagagggtgcctgggtggctcagttaagcctctggttcttggttttggttcaggtcatgatctcagggtcctgggattgagccccacatcaggctccagggtctgcacagagtcagcttgtccctctccctctgctcctcctcatgcatgctctctatctctcccaaattaataaataaaatcttaaaatatatatacataaaagaaagccatagcccctgccccaaaggaaatgagtatctagtggagagaggaagggacaaaaaagtaataatacagggtgaggaatgctttggttgaggtaggcacgggatactacaaagactgaaaagagacacctaacccaggcttggggcaggaggaggggaaggcagtagagggataagacgtttcttaaagggagtgacttgaggtaaatccaagctcaagaacgacatttattcaacaaaaatcagaagcttactgtgtgcccatgtgcttattaggacataaaagcaaggtagatacaatctcagttctcaagaaatttaaagtccagtggataagacagacaagaagtcaggaactgtttctatttcagtaactgtggcagagatcataatgttcatcagatattttatgtgcttgtttatggtatttgaagcccctctgctattaggtggggccacctgactgtttctgactaaggaaatgtgaacagaagggacacacacttcacttctgggctaaggcagggagaaacccacccagtctcttttctcttcctctgtcacagtgcccaaggacatagtgagttccagttggtgtagctgtaagatggggcctctgattggaagagaccctgtgtagagcacagcctctgaaaagtgacttgtaacaagcaatacaactgtgttgtgttaaaacaatgagatttgggggttaatctgtcattacagcataacctagtttatcctgattaacagtgtgagaggtcagtgaaatgtctaaggatctcttctgttgactgcctcatacccaaaccttaagcacagagcttgacccattattagtgtccaataaaagtttaatgagcaaatcaaagaatggtccaatgactgaatgaacaaacaagtgctttaaaaaaggagtgcagaaagcatatagaaggggttactcagggaggctgaacaaaaggcaggggtctaattatcaagagtttggattgaaacctgaaggcaatgggtaaatcaagcaagttgtttaagcaaagaaataacataacccaatttgtttttgtttttaattttaagagtttatttaaacaaaaactaaagccttctgggcagcaccaaactagaagtggctaggagcactcttccaatttgggttttagaaaggtcactttgacttgagctggacgtgggcaagcttggtaagcagaataggttcacacatttaattccggttgagaaaggaggaggacagaagtgagagtgggagggaaattacaagttctcagataaagagaaagaagcttccataggaccaaatgattgacagattatgggctaggtcaatggtggagctgccctccaaggaaaatgtgaaaggtcagtggaggagcaaaccacaaggaggatatcctctgaacatatgaattgaaaatataatgagatgtctagtgaatatttcttttaaagatttatttatttattcatgagagagagagagaggcagagacacaggcagggggagaagcaggctccatgcagggagcccgatgtgggactcaatcccaggacctgggatcatgacctgagccaaaggcagatgctcaaccactgagccacccaggcatccctctagtgaatattttctagtggacaaacatataaatgtgggactggaggtaagagagaagaagagatttgggggaaaaaatggtcttagattctttgagccaggatgagactaacacaagagagaatttacatatttgcaaagctctacctattgttcacccttcttggtgtcagaaaagtttctattcccatcaccaagaccacagtgggggtaaatatattccacatatcctaggttaaagttctggaaatgttttcctttttttttttttttttttttaaagggatgccttggttgctcagcggttgggcatctgccttcagttaggggtgtaatcctggagacaagggattgagtcccgcatcgggctccctgcatggagtctgcttctctctctgcctgtgtctctgcctctctgtctctcataaataaatgaatcttaaaaaaaaaaaaaaaaaaaaaaaagattatgctgataatctacatcacaggaaatcctgattaacaagctatagatcttagatatattactaatttccagaaaactacattcagtaatacacccaacatgatatcatttccaacaatacaatgcccctgacatttgacagcccctcagcacagccattactgccagagaactttgctggtatcctagatgacacaagggctgcaccctaccaaatctgtgatatgctctgcaaactactttacagagtagtttgtaatcatttctgtgctccttcttgtaataagaccaaaataatagtgaataattatctgcttggattccagataaacagaaatgttactattttttacagaatgtattatgtatgtgtgtaaatatttgagatttttaaaaagtaggttccacacccagtgtggagttcgacacagggcttgaactcaccaccctgagaccaagatctgagctgagatgaaaagttgggacacttaaccgactgagccacccagctgccctataacacaatattttcgagaacagctgctacaagttcttgtgtagaaggaccctataaaaatatcaaaaagatgagttaagctctcagcaagaagtcaaataacttgttcaagttaaatcaataagtaatcacagggccaagtattagtagtatcagttcctagagttttgaaaccattttaccctctatttttttccaacacaggagctcaaaatactgctcaaggggacataaacagtcagtttacaaaatgccttataaacatctctttatctagctaatcagactgcttatttaatgaaaggaaattctctgtctagtacaaagaaacatcatactgtgctgtgaatagatattttgacagttttaccttggaaacaaagaggtattttaagaatatgaaaaggtagtcagaaacacaaactctcctgcacggcattcttaagtattgagtcccagggtacagagcatactctggtcttctaagtgagagagtggtctgcacgatcttcctcagttactgttgatgttaaaataccaaagcatttacactgcctggtagtcaacgactttattttaaaaaagaagactaaagaaaccaataagcttggctgtattggcaggttatatgaaaaaaacagagactaaacattgttggattacaatgtttcaatataaccggggtatttctgtaaatctcccccactcccacaggccttgtctatgctgaacgaaaacagactaatcctggggggaaataaataataacaacagcaggtagtatttattcagtgccaattttgtgccaggtgctggcattttacatattctatttttaatatactcttcctaaatttcaaacaaccatacaagctgggtattcttcagtacctgccattatagcaatgaggaagccaagacttagatgatttggtgatgtggcaaagggcacagaaaaaaaaaggtcagtgctgagccaggattcaaaacacagtctacatgtctgactctgaccaccaggccacttagagcctgttatccccatgatatagctagctagccctgtaagaaaaaccctctgaaaactgccatcagataaaagaaaaagatgaagaaggcatcctgatctaatcttgaattcaaaacaaggatttggggcagcccgggtggtgcagcagtttagtgcctgtcttcggcccagggtgtgatcctggagacccgggatcgggtcccatgtcaggctccctgtatggaacctgcttctccctctgcctgtggctctgcccgcccccccttattctctctgtgtctctcgtgaataaataaataaaatctaaaaaaaaaaaaaaaaaaaaaaaacccacaaaacaaggatttggaccagttttatgagcagagactatttgcttgtttattatatcttttctggaggccagagctgttttctacatagaggagacctgtgaattcctctaattatgcaacttctgtacactttcttttctaaaaatgtttattaataaatataaaaaaaaagggatccctgggtggcgcagcggtttagcgcctgcctttggcccagggcatgatcctggagacccgggatcgaatcccacatcgggctcccggtgcatggagcctgcttctccctctgcctgtgtctctgcctctctctctctctctctctctctgtgtgactatcataaataaataaaaattaaaaaaaaaataaatataaaaaatggctactaattcacaatatgatgctctgtaatttttcacatgtttagataccaccataatccaagtaattcatcactaaagcatttattctataaacaactgttgtgctcgcttcgacagcacatatactatataaacaactttgtccagtggcgcctgggtggctcagccggttaagcgtctgccttcagctcaggtcatgatctcagggtcctgcaatcaagctctgcatcccctcaggctccctgctcagcatggagtctgcttctccctatctttctgccctccctctgccccgctcatgctctatcaaataaataaaaccttaaaacaaaaacaaaaacaaactattgtccagttatcacttgcttataaaggaagtgaggcacggagaaagggggggtgagtgggaggcagagatgtataaaaatatagaaagcctacctctgaacagcccactctcatgcaaggattggcaaactgtggcccatggaccaaattcagcctactgatggtttttgtatggcccatgacctatgaatggtctttacctaaaaatggttttcaaatgtttgaaaaagtctaaagaagagtatttgggaacatgtgcatttatacgaaattcaaatcacagtgtccataaataaagtttactggagcatagccatgctcattcatttacctacagtctatggctgctttcaggttacaagggaaaagctgagtagtcctggtaaaaatcaggtgtgcacaaagcacagatattttctatctggtcctttacagaaaaattctgccaagccttgatctaatgaagggcccaatagctacaacatcatgttgataaggcttatgagaggagagaagactctgagagggtcccagaacacttctccaaaaggaacctgtgaactgggccaagaggactttcctgtgcccaggaaggagaggtgctccagaaaggggactgcaactgccaaggcacagttgtggaaacagtgtgttatatcccaggaatgctgagaaatccgagtagtttgataatggtatagggtgcatgatgggaaagaaaaagagaggaatggaggagactgataaattagactggaaccatataaaaaactccatttttgcattaccaaagagttacagcaactgaaggcaactgggaatcctccttggtttttgaagaggaaaatggcaatttcatttgtttgagaagcctactgaatctgaaaggtaatgagtgatgggctattcgaaacagagaggtctggtaatcagcatccttgaagacggggagcaagtggctaagtcatatttaggggtgagcgacggcaggggctgttaactaatcagaaatatgggtgctgtgaaagggatgtggaggctaaggcattttactggagtcaacaggcagacagagatacccatttttcaagagacagaaacacaggaggggagcagatgggaaaagaaaaaaaatttgaggcactaggagaagtttcctgtactccatgtgatgagaacttcacaacctcaatttaaatttccatttgagggatgcccgggtggctcagtgattaagtgtctgtcttcggctcagggcatgatcctggagtcccaggatcaagtcccacattgggctccctgcatggagcttgcttctctctctgcctatgtttctgcctctctctctatgtctctctcatgaataaatgaataaaatctttaaaaaaattaaaaaatgtttccatttgaaagcattcaccccagaaacaatgactgcctctgtatagtacaattggtggcactaaggaggagaaggcattttctttaaaggcatttctttaaaatctcatgtacagcttgaatattttagaacaagcatttaagatttttataattggccaagaagaatgccaagcattattccctaggaaatttctgaaaaccaaataagagtgaatgaaatatttagaacgttcaagtttcctgaggtcattaaaacaaacaaagccacagcaacaacattcctgacatccataagctgcattattttcccacacacgatcttagaactgtaggaatacactgtaaaatcactgtttatcaataacactgattttgctgagccatacacaaatgatgtcttccaaaatgcaggttcataaaaaacgatgctcctgcagattcaaaggcaggtatgtatcttgtccccagagtagcaggaatgtatcaatcacatttcaatctaacttgagatggcaaagtttaaaaccatacttgtatgctgtctactttatagaggagggcagtcagagacttggcttataaatcggcctcacaccaattcgccacacgactgaaaaaaaaaacaaaacaaaaccccacagacttcaactttctcagttttaaaatgaggttgttcaaataatctcaaaatcctcaccagcactgacattccattgttctaaatttacacaggtgtgtgtgcctggaagagtggttcctaattctttttattttttataatatatttttttttagtggtacacactacacttgttaaaatagtacaaaaggacattccgtgaaaagtaagccttctttcctacatctgaccccagaggcacttcttatgaagacttcttgagatatcttagcatatatgagtataaatagatacatattatttttttctttgttacctcaaatagtaagccatcacatacactgtccttagtttttcactttaatcgcagaaatcatcgtatcattacataccaaagaaactccttttttttttttttttaatttagttatgagagacacacagaaagaggcagagacataggcagagggagaagcagactccccacagggagtcccaagaccccaggatcatgacctgagccaaaggcagccgctcaaccactaagccacctaggtacccctcctgttttttttctcttaatggccatgcggtaattttaaaaactgctttattttagaaaattccaaacatacacaaaagtagaggaaaaatataatgaatctccacatattcattacccagctttagtaattattaacattttgcctatcatgttttatttgcctaaaccccattcccagagtagcttaaagcaaatcccagacatcgatatatttcatcactaaatactccagttacattatcactaacggataaggacttttaaaaaatatgatcatgaggcgcctggatggctcagttggttaaacatccaactcatgatatcatggtggggagatcaagctccgcatcatgcaccctatctcctcaggtcagcaaagagtctgcttgagattttctcctcttccctgtcccttccccgactcttgcatgtgtgcattctgttctctttctctctctcaaataaatctttaaaaaaatatataaccacaatgtcattattaaacctagcaaatgagtaattgcttataatcatctaataaacaggccatattcaaatttttccaatcgtttaaaaaatgttattttacaactgatttattttttttaagattacttatttactcatagagacacacacacacatacacagagagagagagagagagagagagaggcagagagagagaagcaggcaccatgcagagagcctgacgtgggactcgatccagggtctccaggagcacaccctaggctgcaggcggcgctaaaccgctgcgccactggggctgccctcaactgatttatttagataaagatcccaaagaagtccaatcattgcatttggttggtatgactcataagccttagtctaaagcagttccccctcctggcccatggttttcaaaccatttatttgttgtagaaaacatttatcttgtaggatttcccaacttcctgctttttctagtgccttccctctgtggtaatattcaacttggtcctctctctcccacagttcctgtactcaggtgggaagatcttgaagcctaatcaagtttgtttttattttggcaagaaaacttcactgccagtgccacatacttgctatagcactgcactgtcagacaataagatttgacatcagctttaatgatgagatgaaactggtgtcaagagctcccatgtgatctatccatgacagagctcaccgtcagcctttctttgactggttgtagcatctattaatgatacccattctatatccataactgcattagggaatacaaatgataattttctaattctatcatcccttttatattaactgaaatttccacaaagaagaaacttcttcactgactgattatcctaacagaggaaaggtaagataaatgcttttttcctcctcctaattcactaatttttagaaaaatgagagtgtccaagctacctccaaatattttgttgttactcttgttactgtgttaatacttcctatgtttcaatcgattgtagtcattagttttttttttttttaagattttatttatttattcatgacagacacacagagagggagaggcagacacagggagagggagaagcaggctccacgcaggaagcccagacgcgggactcaatcttgggtctccaggatccagccctgggctgaaggcggcgctaaactgctgagccaccagggctgccctgtagtcattagttttttggttctcccacctttaaccagcaagagctagttctagctagtctagcaagagctgcttcaggttggattccgtctttttcaactagcacttaattataacaattttcaaatatacagttaagttgaaagaaccatatggtagccacccacaggcttaccacatatatcctaacagtaatgttttacaaatcttgtttatctcacatatttttgacataagtctttaatcttgtatagctgtcttgcttttttgtcacggtcacatctcagggtcattgtaagcactgcctgccccaaatctgaatttagctggttcttagtgggaaatgatatttagaggcctcaatttaggtactggcactgttgtgttgtcattgtttctaaagcctttcattttcaatggcagataggaaatatgtattattagaacggaaacaataggggcacctgggtggctcagtcggttaagtgtctgcctttagctcaggtcataatcccagggtcttggggtcgagccgcatgttgggctccccactcagcgaggagtctacttctctctctctccctctgcctctcccttggctggtgctttcactctttttctctctcaaataataaatactttttacaaaaaaaatgaaaataggataattgaagagaaaaatgaattatgggttatgctgatatttccatttcagatttagagttactgagcttttggggcacctagctggctcagatgatggagcatgcaactcttgatcagagggttgagtttgaacccgtggtgggtgtagagattacttaaaatcttttaaaaagtttactgagcttttaactaattggattttatgcttacatatattttttatcctaaaagataacattaatataattatctgagttgtcctgtaatataatagtttcaaatcaatagcactattagctataaaaccactaactacagttcaaggttctttgtagttcttcttagcttaaggatagatcctactagagatgttcaatcaaaacactgttttaaagtcacatgaaagatttaccttctgtacaattatgccactaacttgatacacaaattcgttttttcatttataggaaatacattttgttgtaactgaattattattcacactcactggaacttacagactgtcagggcacagctcaatgagtctgactaatgcatgcacctgatcccatatacattcctataaggatacatgtttccatcttcccagaaagttccctgtgactctttcctgtcaatgcccccaacccagaaacaatcgccattgtgatttataccatcatagattagttttgcctgttctgggtcttcatataaatgaaatcatacatatctccaactggggactttatgatatggttgtaccacaatttatttaatcacacgtcttgacggacattttgggtatttccaatttctgctattaaaacaatgctacaataaacagccctatacacaaatcactttccaaatgtgaatatactgatagaattcataaattcattccctcattaaactaacagccattgaatatctactcagggccaatcactgtctaagcactgtggagacagcaataagcataacaaaagccctgttcttttggaatgtacaatctaatggaagacgacagacaataaactaaaataaagtcaggtgatcagaaatactaataagaagaaaaagaccagggacacctgggtggctcagtggtttagtgcctgcctttggcccagggggtgatcctggagtcccaggatcaagtcccatatcagcctccctccatggagcctgcttcttcctctgcctgtgtctctgcatctctccctgtgtccctcatgaataaataaataaaatctcagggatccctgggtggcgcagtggtttagcgcctgcctttggcccagggcacaatcctgaagacccgggatcgaatcccacatcgggctcccggtgcatggagcctgcttctccctctgcctgtgtctctgcctctgtgtgtgtgtgtgtgtgtgtgtgtgtgtgtgtgagactatcataaataaataaaaataaaaaataaaataaaataaaatctaaaaaaaaaaaaaaaaaagaccaaaaaaggaagtagaaattaacagagtactcttttagacagagaggtcagggaaagtctctcctaaaaggggatgtttgagcgcagatctgactgaagtgaagaaaacaagcctttggctctctagggaaaggtaccctcagaaacaaagttcctgccctgaggccgcaaggtctaggtaagaaagccagcatggctagagcagaataagtaaggaaaaaagtaggaggaggggaacaggtcatagagggaatcacaagttaaggaggtaaggacttgggatcgtatcccaagtgaagaagaatgcccctgaggggttctaagcaaacatctggaacagttactggagaatagattgcaaggttgaacaagggtgggataaaacaggaggatctatgctagtccaaggagagaagtgaagatggtttcagactaaagggataacagggagaaagaagtggtaacattctgactcttcttctaaaggtagagccaagagaagtcttgatatgggctatgagaaaaagaaggaagtcaaagatgacttcagttcctggacctgagccaatggacaaaatgggaaaacaatgggaggagcaggtctggcaggtaataccgggagttcagctttgcgcatgttgagtctgagctgcctatcaaacacacagatggagctgctgagaaggcagttggagagatgaatctgctgttcaacaaagaggtcagagacagagattaacatctagcagtgtgcagaatttggggctggacgagattatttagagagaaaatctggagcactcctagcttctgccctggggctcttcaatgttttgcaggattcaacaaaggagtccaagaaggaacaaatagtgagtgcgaaagaaaatcaagcaaaaaggcatgcaagaaaccaagaaaagtgtttgaaagaggaaggaacgaccaactgagttaaacaccactaagaggtcaagaaagatgaagactaataagaatggagcatttgatttgataacatagaggtcatttggatcaagataaaggtattttctttatacaatctaagaactgctataaagataagacacatttgtaattttaataaatgctgatactttgcctcccacagaggttttacaggtttatacatgcctgccagtagtgtatgaggctcactgttccctcacgttcttatcacatgtggtattatcctattttttgacactggccgatctcacaggtaaaacatggccatctccttttagtttcaatttgcatttctcttattacaagagaggtgttgcatctttcacatatttgagagtcacttgtatttcctttgcataccctctgccaatttttctattgggttattggttttttcctcattgatttggagaagctcttcacataatattaagtaaattagcctggtgattgtcaatttgactttatggtgattttaccatgtagaagctttctatttttctgtaattgtatatatatatatatatattttttttttgccagtcagatgtgttccccctcccagctttaatgaggtattgtttgtttactatttattaaaaaataaaattataaatttacagggtgtgacataatgacttgatactcataatatgctgtaaaaggattactgcaataaagttagttaatacatccattacttcatatagtcaccattttgtgtgcctggtgagaatatccaacaatttttttttttttttttaagaatatccaatttcaagtatgcaacactgtatttactaactacagtcaccactgtatacatttgctctccagaactacattttataacttcaagttcgggtacctggctggctcagtcagtagggcatggggctcttgctctctgggtttgtgaattttgagccccaagttggggataaaagttacttaaaaaaacaaaaaacaaaaaacaaaaacaacttgaagtttatacccttagatcaacatttcctcattttccccatcccccagactctggtaaccaccattctaccctgtttctgagttcaactcttttagattctacgtataagtgagatcgttagagcatttgtcttcctatgttggacttacttcacttagcgttatgccctcaagatttacccagagttgttacaaatggtaggattttgggcagcccaggtggctcagcagtttagcaccaccttcagccctagggcctggcctgatcctgaagacccgggatcaagtcccacgtcaggctccctgcatggagcctggttctccctctgcctgtgtctctctgtttgtgtctctcattaataaataaataaaatcttaaaaaggtaggatttccttctttttttagctgaataatatctgtgtgtgagtgcagatgcaccacattttccttatgcattcatccatcaacagacactaaggttgtttccatgtcttgactactgtgaattaatgccacaaggaacaaaggggtgcagttatctgagatactcacttcatttctttcagaggcactcagaaataggactgctggatcatagggtagttcaatttttggaggaacctccaaactggtctccataatggctgtaccaatttacattctctttggtaagagcgtttaatagtatgttagtttagttagtatgttggttgatagtttaacagtatgtcattgtggggggttttgcatttctttgattactaatgaggctgagtactttaaaaaatgttctcaggccatctgggtttccacttttatcacgggcttgatcaagtttagggtccatttttctactgtgttcttttctggttggtaggagttctttacagattttgttatacattcaaatattttctcccattcttgaggactctcttcattctttcgtatcttttgatgaacacaagttactaactttgatgaatacactttttttcccctttatggttagtattttctgtttcttggctaagaaatccgccccttccttgagatcataaagctcttctacatcaggggttggcaaactttttcaataaaaggccaggtagtaaatattttcagctctgtgggctgtatattctttcttttcttttttttttttttttttttttttttgggggctgtatattctgttgcaactatcagctctaccattgcagcacagacgctgtgagagacaatacataaatgaatgtggctatgattcttgaaaacttaatttacagtggtgcctaggtggctcagtcaaacatccaactttcgattttggctcaggtcatgatctcagagccatggaactgagttccatgctgggctcacaaatggggcagggagcctgcttaagatcctctccctcccagacgaaatcagagagggagacaaaccgtaagagacccttaactctaggaaaatggagggctgttggctaaaacagggctaaaccgctgagccacctgggctgcccttgatgctcttttaaatgatattcttaaaatttcaatttctgttaactgctagtatacacaaaatactgatttctgcatactgatcttatcctttttccacactaaaatcacttactagttctggtaactgggacgcctgggtggctcagcgactgagcatctgccttcagctcagggcgtgatcccagagtcctgggatcaagtcccacattaggctccctgcaaagagcctgcttctccctctgcctatgtctccgcctctctctctctctctctaggtctctcatgaataaataaaatcttcaaaaaaaaaaaaatagttctggtaactttttgatagattccttaggattttctacatagatgatcaagtaagctgcaaaaaaaaagacagttttacttcttcctctcatatcattcattcattcatttttgccttactgtactagacaggactttcagaacagtgattaacagaagtggtaagaacagacatccttgtctggttcaccatcttaaggagaatgtatgtatttttttcaatactaaagtatacagcgcctgggcagctcagttggttgtgtctgactcttgattttggcttaagttgtgatctcacggtcatgagactgagtcccaagttaggctccgtgctcagggcagtctgcttgggattctctccttccctctctacctctctccacctctgctcctcccctggctcatattcttaaaaataaataaaatattaaatatatagatatagtaaagcataatggtagttgttttgagtagctattatcatgttgaggaagttcctaccttttcctagtttgctgaggctttttatcataaatggatattgaattttgtctaagactttttctaaatctgctgatattgatatggtttttcttttttttagtctgttaatgtagtggattttactgattgatttttcttttcttttttttagattttatttatttattaatgagagacagagacagagagacagagacagagagagacagagacagagacagagacagagagagagagaggcagaggcagagggagaagcaggctccacgcagggaacccgacgtgggacttgatcccgggactccaggatcacgccccaggctgaaggcagatgctcaaccgctgagccacccaggcattcccactgattgatttttcaaatgttaaatcagccttgcatttctggaattcatgtggttagattgtcatcatctattactctttttgtatattggtggactcaagttgctaagatgtagttaaataaatacaaatgggactcaggagttaacttgaagagactcctactagtcaaaaatcaatatgatgaactcatggattgaaccataggtgatgtactcattaatttggggaataatgctacactaaggggaaaacctacctttcctgtatgaactttttactgtatgattatgatattgtggatggggttctaaaagagttctatttcagaagtatttactaggggcacctgggtggctcagtggttgagtgtctgcctttggctcaggtcatgatcccggggtcctgcagggagcctgcttcttcctctgcctctctctgtgtgtctctcatgaataaataaaatcttaaaaaaaaagtacctactaaaaatttatggacaaaattatatgatgtttaagatttgatcagataacagaggaggagagaagtggttaggaatacacatgaagcaaaaccagctatgagttgctaacagctgaaactgacagagagatacgtatgggttcattatactatctagtgtacatttgtacagatttgaaattttctttttttttagaagatttatttttgagagagagtgaacacacatacatgagcacacatgggtgggcacatgagaggcagagaaaaagagggagaaggagagaagcagataccccactgaattcagagccccactcagggctggatctcactaccctgaaattaggggaaattaagagtcaagatttgaaattttcagtaacattcttttaatgtcttggttattcttagccatgtacttccatatatatttgggaattaaatggcataattagaaggtcctgctccagtccaagactgtaacaaaacgaccttatgtcttcttacagaaatttatggttttagtttcttatttatatttcctatttacaatggaagctattccgctataaacataaaaatccaactttatattttttagacgactcgccaatttatttctggactacctattctgttgcattgattcatttgcctactcctgatccaatttccaagcattctatattacgtaacatagctttgcaacatggtttaattggactagatatcaccactaccacccttcattcttctgtttccaaattttactggctattcttccatgtttatttatcgatttgaccctcagaaattgcttgagctgtttaaataagacatttctaatttctacaagaaacaagtttaatttgtagattaacttagcaagaactgacatcttgtgatgctgaaccttcctacctaggaaaacggtacatttttccatcctctcagtgacattttagaagttttctttgcacacatcttacctatttcttcagtttattattttttgtcactgttataatgggctcctaactattctgctgcttattatttcaaagaaatcacaccaaaattttccagattactattaaaataatattaaatccacacataagcacatcaaatgattaaaaggaaattatttaaaaaaataaaataaaaggaaattatttttagtaaaaaaagcaatttttaactttataccaatgtattatttttttttttttttttttttttacaccaatgtattataaacctaatggtttacaccatggctacagcctgcccagttatagccacgagcagatgtaccggaaagccacactttatggtagtgtcagatgagcagtaagtagggggcaggcaggtcacaaataactattcttttgcaactctgaccgcatatgtgtgaactccagcttatcattcttatgaaaatgaaaacacaaaagaggtcaaacatataaggtgctccaagaataaaccaaatatttaactatatacgagaaaattaagatgaaaagattttatgtcatttcaaatactattatttcacaaatttctgtttctaacataatcaagctgttgaactattttattctaccacaaattatacttcatttactctatttaggaagatggagagtgtcactagaaatcagaaaaaaatgggtagcaactgctttaaaattgtgctatccctgtcaaataaataaaacctttaaaaagttaatataaatgaatcttctataatcaaacatctattataggaatcataagaaactgctaagactggttgactgcaaggaaggaaactgggtaactgggaggacaagtatgggaaggggaattttcactgaatcccaactgtaccttttgaattttatttttttaaagattttgtttatttgaggggagaaagagagagagagagagagagagagaatgcatgtgcgtgtacaagcaggggaaggggcagagggagaagcagattctcaggctgagcagggacctggatgtaaggctccaccccaggaccctgggatcatgacctgagctgaaggcagacacttaaccaactgagccacccaggcaccctgcaccttttgaattttaaatcatataaaaagagacgcctgggtggttcagtggttgagcgtctgccttttgcttggggcacgatcctggagtcccaggatcgagtcccacatcgggctccctgcatggagcctgcttctccttctgcctatgtctctgcctctctctgtgtctgtcatgaataaataaataaataaatgaaatcttaaaaaaaaaaaataaaccaaacacattcaaagatactgccactataacattcaaattccctatacatgagaattactctataaatacatcttaaaatgtaatgtcaggaaaagtctatttctagactaatttatatttgttctttgtcagtctctaaaaagccattagtcctatcacattttcctttctttttagctaaccccatagggatctagatttagtggatgactgcccacttctggttatatctctctattgatctcgttaaaatttataccctgtctgtttcatatattttttaaaagatttatttatttgtttgtttgagagagaacgagacagagagaaggaacacacgtgcgagcaaggggaggggccaaagaaaggggagaaagaaaatctcaagtggactccacaaagagcacggagcccaatgcagggcttgatcccataaccccaaggtcatgacctgagccaaaatcaagagctggatgcttaactgactgaggcactcaggagcccctgtttcatatatttttaatgcaaactctcataaattattttcttaaaataaagaaacccaaaattatattcttgacattcctttattcagccattaggagaccaaactaaaaattactctgtcctaccctgagaaaagcattattcctgaacaattaatttggccacatttttgtaattcctctaaaacttttactttaacaatgtgatcctaaatttgtctctcaattgtacttcaaagcatctggagaatgaaatatcctcacaacacccacctgatgaagtatgtagaaaacaaagcctttttatccatgaaatcataatgaattataagttgccatttaataacagaacattctataagaaaaacatttaagagaatactttttaaaactagtttttttggggcacctgggtggctctgtctgttaggcatctgccttcggcttgggtcatctcaggatcctgggatcaagccctacatcgggctccctgttcaatgaggagtctgcttctccctctccgtctgccactccccctgcttgtgctttctcactgtcaaataaataaaatcttaaaaaaaaaaaaaggatgaatagttgctaaaggttgggggcagggaagaatgaaacggaaagagaacagaggattgagtctgcttctccctctccctctgccactccccctgcttgtgctttctcactgtcaaataaataaaatcttaaaaaaaaaggatgaatagttgctaaaggttgggggcagggaaggatgaaacagagaacagaggatttttagggcagtaaaactattctgtatgacactccaatggtgatatatgttattatacatatatcaaaatccacagaatatacaacaccaagagcgaacactcatataaagtatggatttggggtgataatgatgtggcaaggtaggatcagtgccttgtaccactgtaccactgtaccattgagtggtaccaatgtaccactctggtgggggatgctgacaatggggtaggttttaagtgtgtgggtgcagagggcatacaggcactttctgtacttatcactcgattttgttgtgaacctaaaactgctctggtaaacaaagtctatttaaaaaagctttcaaatattttttaaaggtactagtatattttaaaacacaattgctggactactttaaaggaacggtaaaggttcaatctaagcttacagaattattagtatagcaatttaaaatgtcttaaatatattcatatttatttatttgctgtgcttttaatataatctaacttaattctcataataatcctaggaattaagatgttgttagtggatgcacttctattttagcacttctattttacacttgaagaaactggtttaagaagagtaactcagacctgaactacagacctgactctaacaccatgttctttccaccacatggactctggctgaatgctattgcactacccaccatgagctaacactcataatgagaatcctgggagtctgtgtctgtagaaagagcaaattacacttggaactttggttccatagcacatggtctcaatttgcaaaacatcctcagtatatcataatgattaatcacgatactcaaaaaataccagtacaagtgtcctcttgctctccacttttctgagtaaccaaaagctgacatgttcatagctggtttatgagctatgcggctgcattacatgttaacagccagaccaagactcattctgttctaagccagtggagcctgggagtcctccagatccacagactcaccttaacaaggataaagggttatctgggttcctttgcaagctaacaagtactgacatttcatcacttccactagaggaagggagctaccgaagacagatcagccaaaattgcaaataaccagaaaaaggaaaacacaaagagcagactgaactccttatccaccctcagccccaaaaaataactcagtttttatccttgcccattaagaggagtgagggaagcaggcttgtcatttaagggtaagaagcaaactcagcagtcgtgggagattagggagtcttggcagtgggaaaagatggcccaaaatagatgtattaaacatggcaaggtgagagttctgatcagcacatatttttagtaattgcacatttacaacattcacatgtccagttcaaaattagtttagctagcagtcttctaaaatgccagaaaaattattcctacccccacaatcatcttcacaatggaaataactacaagaccaaagcccagcactggggcacctgggtggctcaatttggttaagtgacttgcctttggctttgatcatgatcccaggatcctgggacagagctctgcattgggctccctactcatggggagtctgcttctccctctcccgctctgccattcccccagcttgtgctctctctcaaaaaaaataaataaaatcttaaaaacaaaacaaaacagaaacacaacactgattctgccattgccctgtgaccttgtaaagccaccctgacaggtacagcattcactcccaccattcctcttcacttaccctacacccctgcctccagtccaacggaacttactctatgctccacatctgatttgtgggtgggcatgatggggggcagccaaaggaaagcaggaaggaaaggaaaagaaatgtggcagagacttctaggtgtcagccacctagaacaggcatctgttcctggcttcatcctcgggaggctgaacaaggaagctatttgctaactaaccagattgagtcaagctctcaagtaagacccgacttgaccatacattgtcttaggtcacacatttctcagctggtattttctgtcgctgtcaaattattatatcacaatggctgtttttatctacctctgctggacatcaagaaacaacagacatattttagaagattttaaaaagtcagaaaagaagactgacataggaaacagaaacagtttgtaagttgcccttactgtcattgcaaatacaactctatttaaatgctctcatttaaaaagctcagtctctgttctttagcactgaaaaaactcctgtgttatttccaatagcagctcaacctgtgcatctcttctatagaagcttaaaacaaaaacaaaaacaagtatttgtttgaatagggaaggaaatcaacaaaaaggcaatctactgaggagatattgatatgtccaataaggggttaatattcaaaatatataaagaatttatagaattcaacaccaaataatccaaggaaaaaatgggcagagggcttgaagagacatttttccaaagtatatccagatggccaacagacacatgaaaagatactcaacatcacccaacatcaggaaaatgcaaatcaaaaccacaaagagattagcacctcacacctgtcagaaaggctaaaataaataacacaggaaacaagtgttggcaaggatgtggagaaaaaggaacccgtgtgcactgttggtgggaatgtaagctggtacagccactatggaaaaagagtatggaggctcctaaaaaattaaaaatagaattatcatatgatccagaatttccactaccaggtatttaccgaaagaaaatgaaaacattaatttgaaaaggtatctgcacccctatgtttagtgtggcattatgaatggataaagaagacctggtgtgtgtgttatgtatacacacgatggatgttactcagccataaaaatgaatgaaatcttgccatttacaacatggatggatctagagggtataataccaagaggagtaagtcagagaaagacaaatactatatgatttcattcgcatatggaatttaacaatcaatacaaatgaacaaaggaaaaaagacaaaagaacagactctgaaatacagagaactgatggttaccgggggggggcggtgggtggataaaatacacaaaggaaattaagagtacacctattatgatgagcactgagtaatgtagagaattgttgaatcaatatactgcacacctgaaactaatgtaacactatataaattacacttgaatataaaaattgttaaataataaaaaatcagtacattgtattttaaaatacttgtgtttttactaataatttttttttaagattaggcagagacacaggcagagggagaagggctccatgcagggagcccgatgtgggacttgatcccgggactccaggatcatgccctgggccaaaggcaggcgctgaaccactgggccacccagggacccccaatttattatttttttttaaagattttatttacttattcatgagagacacagagagagaggcagagacataggcagaaggagaagcaggctccctgcagggagcccaacgtgggactcgatcctgggactccaggatcacgccctgggcctaaggcagactctcaactgctgagccactcaggcgtccctgtttttactaataatttctaaatgaactgctaaggacagtttctaaataacagaaatcattatataaattctatccatcctttaagattcaacacaagtgtcacaaccaataatagtgtcacaagtgtcacaaccaacattcatttgaatacagaagacagaaggagcactagcataaaaatgtaactttctaaggcagataagtctgcaacattctttcacaacaatttcttatcagatgtgcaagttgcactcaattgatcaaaatcattatatataactgggctaggttctcacacttcagaagctaacagcaaaagaagacagaatgataaatagtccatctggactttttcttagtgggaattaagggttattcatactttcatgttactgaaagatacttgcaaaaggcatcctgaaatctcttttctctcatcatttagaaataaaattattgggcagccccggtggctcagcgatttagcgctgtgttcggcccagagcatgatcctggagtcccgggatcgagtcccacattgggctccctgcatggagcctgcttctccccctgcctgtgtctctgcctctctccctgtctctcatttataaatataatcttaaaaaaaaaaaaagaaataaaattattctaaaaatataaaataaaccagtagcttttgaaaaatcaaaggtaaaaactccagacatcacatcatataagcaacttttgtctattttgtaaaccataatgcacaattacatctcaatgtacatttcaatatgcattaggtaccaaataatttatttgttgagaaatcacactattcataatgattaaactaaacaatgtgaattatctagcaaatgaagacaaatatatttatatattagcattcatttattcattcaaaaactatctcttgagaatgtgcacacattgggctcttgtctaggcacaagagctacactgatgaacccaacaggagactgcagctctggagtcactgttaaggcagggagtcacaaaacacgtaaacaaggtgatttcagtgataagcgtcatgaagaaaaagagcatgatgtgacagtgtgtgacttggagaggtacatgaaagagacccaggcaagacctctcagaaaaaccaagagactgatataaagagattcatcttttacttaaaattatttattcatcacatcccacctcagcatggtgaaaagatttttaaaaattcctacaaaaaaaacaaaaacagggatccctgggtggcgcagcggtttggcgcctgcctttggcccggggcgcgatcctggaaacccgggatcgaatcccacgtccggctcccggtgcatggagcctgcttctccctctgcctgtgtctctgcctctctgtctctctctgtgtgactatcatgaataaataaataaaatcttaaaaaaaaaaaaaacaaaaaaaaaaaacaaaaaaagaattcctacagaggtttacagctagccatgacttgaacaggtgtccaaatggtcttctcaggaacctcacagagttactgagcagctagctggtgcaactccaaagtggggagactaaccccatcctcttcttggaaagactaacacaggcacctgtgttaaaatacatactattcagaatcttggagacaaaaaaaaaaaaaaagattcttggagacaaatctgagattccctagaggcagtttatcataaattaattacctgcataagggcctgaaacatattatttagaaagtgttaaattttttggtctggtttatttttaagaattggcgactcctgaaaaaaatagtgcaaatattactcaaaatccaagtagaaaaaaaaaatccaagtggattatttatggactatttctaatagtttgtatctgccctggtagataaagttggttttgctgccttcttagcaccaatccacaaagcatttccaggatgtcctttgaacccaaatatgaccatatcctttgctccagagaactattaaaagagcacctgggtggctcagatggttaagcatctgccttcggctcaggtctcctgggatgaagctccacactgggttccctgctcaggagtgagcttgcctctccctctccttctgcctctgcctctccccctgcttgtgcttgctctataaatgaatgaatgaatgaatgaatgaattacactttaaaaaattttatttatccagttgagagagagagagagagagagcacacatgctctcgagtataagcagggggaggggcagaggcagaggcagaagcaggttcaccaccaagctgggagcccgacatggggccagattccaggacccggggatcatgacgtgggccaaaggcaggcgctgaaccatctgagccactcaggtgcccaataaataaaatcttacaaaaaaaaaaaaaaaaagagtgcacagctcaaattcatcttagctctttggcctcagtatgaaaggtcaaactgccatgtcatctggagaaagagcattggaggtttgaggaggggataagatggcaaaactaggtgcctgctttcttcctgtacttggtcttcacactgcagtgccaccaaccatcctttaagttcaggatctttcatccatcccaagttcaagtcagcaaccaaggggttaccagggccaccttctccctctcctttatcccttatatccaacctcctaccaaatccaaatccagaggatcttcccattgacatttttgaaatctgtccactcttctcagctccacaacagctaatttgattcaaggtatttacatgacaggaccactacagtaaactgtctacctgtctaccagtctgcctgtgctcttccccctctaatttcttcccaccccacagcctgaattatctttcaaaacaaaaatctggtccagtttttgactcactcctgcttttattaaaactcttcaaatgtggggatccctggatggctcagtggtttgccacctgccttcagcctggggcgtaatccgggagtcctgggatcaagtccagcatcgggctctctgcatggagtctgcttctccctctgctgtgtctctgcttctctctctctctgtatacctctcatggataaataaataaaatatttaaaacaaaacaaaacaaaaaaaacgtcttctaatgcctcccattactttaagaatcacaacttttatcaggtgaaaatataaattaaacaagattggtcaagtactgattaaagctagataactacactaagtagtgtatatttgtcactcttctgtgtatgttcataattttccacagtaaaaaagttaaaaagtaaatatccaccaagaagcaaataaacaaagacccaatgccaaagaccaaggctaacaaggacctctacggtctggccccactgacttcacttcatgcttgtactctgcacctctgtaccattggcctactttcaattctttaaacactccactccctcttgatacagtgtttgcacagttgttccctcaatctgaaatgccctgcccaatgcctagttaactcttactcattctttagagatcagggcagccctccctagttaactcttactcattctttagagatcagggcagcctgcccaccatgtccatatcaaggttttctgtcaaatgggttcacttgactaatgatgttcttttcctagacaatgccacttcagtttgtgatcaaacgtttctgagtgtgattaactctaaagttcaaagagcagagtccatatttttgcttatcgttgaataccaagcatctagtacaggacttggcagacagaacagccaatgctttaacggtagttggtgaatgatctattttaccacctaagactatcaagggaactgctttcaaacttcctataacaaaacacattctaaagtttttaaaaatcatttgctattttggtctcagtttccctcaagtggcaacagagaaatcactctgatttattccctttgcagagtctttcctttgagatattggagtccttaacattcctgtgatggaagtatcatgattacccaccaaaaataaccacataaatcaacagcctggtctctttttcactcttctgtatagttgcttgtcctccctccccaaaatcaagatcaaaggactggaggataaattccctctcagaccccaggaacttcccttcatgtcctgctccagatggctgacaagcatatttctattaggaatgcttcagcagaggccccaggacttcactccattctgcttcccttgtgatcaccactaacattccttctgcaatataatccaaccatcatcacagtgtcatttcatttgcactctgtggtaaactgacattaaatgatatggtttatgtttttattttattaaaacttctgggtgataggcagaaagcagaataaactagaaattaaatcagatttaaataattctattagaacatgttaacatttaatgtaacaattcatataattagacagtgacatcttgaacattaatttcaatacttcttagaactacagtgctattaggaccctaagaaataaatggccaagagactaaattatcaaaaatatttttattttttatttttttaaagattttatttatttattcatgagagacacagagagagagagagagaggcagagactcaggcagaaggagaagcaggctccatgcagggagcctgacgtgggactcgatcccggatctccaggatcacgccctgggctgaaggcggcgctaaaccgctgagccaccagggctgccctcaaaaatctttaacaaaaaaaaaaaaaaaaaaagattttatgtatttattcatgagagacacagagagaaaggcagagacacaggcagagggagacatagccagattgagagggactcaatcacaagacctagggaccacgccctgtgctgaaggcagacactcaaccactgagccacccaggtgccccatcaaagtatcttttaaacaaaaattccatgaagcatgtagaacagacttcaccaattaactcagacaacgttaatccaaatttataactgaggagctgattacaaatttaacttttattcacatgacctgctaagtaaatcaacagtaaggtccaaataaatttaaacacccttaagcacttgttcatatgaaaataatccatgttaactactaatcattcttgccaattgcagctagatagtgagggccttcattcactaggaatactcaaatgctatgtatctatctatgcatcaagaaagctccataacacaggtacatctccaaggtatcaagggtgtggtttccagaccatgaaataaagcaaatgtttccataaaatgagtcaaatgagttttttggtttcccaatgtatataaaagctatgttttaggggtacctaggtggctcagttggttatgtcgactcttgatttcggctcagttcacaatctcagggttgtgagatcaagccctgtactgggctctatagtcaacagggagtctgcttttctccctctctctctccctctacccctcccctgcttgcctctcccccacttctctctaaaataaatctataaatcttaaaaaaaaaaaaaaagtaggctccatgtccaatgtggggcttgaactcacgaccctgagatcaagagttgcacactcctgggccagccaggcaccctgtgtatagatttttcgatcagtcttctacttctttatctttcagcttattgcctacaagtggaattaggtggacagctttgagatcttccatactctcaatgaaaagctttgcctgtacacataattcttccgggtaagtctcagctagcaatcttcaggattattgtcagcccacaatatagtgttaattctgtactatgggctgtcatcttcctatacacaaccaaggcaatcatcattctcaagaaactcctgaaccattaatccaggatgcaaaagaaacatgttaagggcactgaaactcagacctatagcaatgttaagagttgtggcaggcagggaaaaacacacgacagctgatcagcctgaccacttcagaaggactatgctaccaataagagatgactccacaaatcctggactcagtcacatagcaacaaagtctatccacattaagagtgagaaaatggctactcacctatgtattgtcttttcaaacttacacacaagacgacaccagtttacagcatcatttgaaaatacaaaaaaaatgacgatatacatatgacacgctaaggatcaagaacaaagaaagaattacaaaaacattaatgatgtatggttggtttttgttttgttgcttctcctaaagttaactgtttaaaagcttcaattatatactttaataaagaaaatgaatctaggtttcacacaaaagagtaactattaagcaatatactttcaaatgtataataaatcactctgattaggcaaagtccttaagagttctaggaatggacgacttgaaaaaatgtgatttgtttttttggatttgttttcttccttcactagaaagcaactggccattggtttcatagatctgtattgtgtatcaaagttcaaaacacattttacataaccaatggatgttatttcactagtgttgttagcatataaaatagatttgatgtaatcaactggttttgtccttttgctttcccaatattaagtttttctaacatctttgtatattatttacaagaactgtgaagtataatataaccattaaaacaaggataattctaaggcaacctgactgcaaaagctaatcctttgagtacaaataaaatatcatacactaatcaggcagtactttaaaaatattccttgataagaaaggtaacacattagaaacttaaagaaatgtaaatatatcttatttagtgagactatggaaccaaaatggaagctctgtaacacttaatcctagaattcacttgagataatcagatgtgaaattcacacttagcctatttcttgttataccccagagggtccttttatggcttctttgccatttcacagctatacttgatgtggcacattacccttaactgccccaccctcactctcttggtttttgttttgctgagaatagacacaatctaaaaagaatatccatgtttccatcctacaacttagctacttatctgcatccatgtccataaaccctgcctttcctcccagtcctacaaagacactatctgtgctccaagtgaaaaccaacccctccatttgtgcacaagatcttctctctgtcctacttaaagacactgctccagcaattctctcttctgaatcttaacatttcacctctttaccaaatcagatcatttccattagcataaaacatgctgtatttctcccttaagaaaaccaaaccctctcgtgactccatatcctatctactgttctttatagctaaattattcagtaaaattgtctatactaatatatattcttttcccactcagtcctgaacccactgcaaacagaattttgccccctatcaaagtcaccaattaccttcttgttgccccatctaatagtcaactcagtcttcatccacttgacccactagcccttgtcatagtaacattcactctgcattgaatcaacctttccttggcttccagaatacatactcttctgattttcttgctcccttgtttgctactctttgctatctcctcagcctctaaatcatgcagtgttagaggccttagtccttaaggtgtcttctcttctatagctacttatgctctttgtgactctgtccgagactatggcttaaaatactactgataggctgacaacttccaaatttatacctccagcccattcctctcccctaaacactattttctgtatatagtgggtctcttccccatcccaaacctgctccttcagtacttttcttcatgccaaggaaatggcagctctacccttccagttactctggtcaaaaccctaaaggccacccctgacctgacttgcatcttacactcaacaaaatcccatcttcatatataacccaactgtgacctcatatcactttcactgccaccattacaaagaccttgactaaataagattgtatcttgtgaagatcctaacacagtgcctggcacaaaaagcacttgactaatgcctttccttccaccagtttcacatcaggctgtagtcagaatcacttagaaacagcagttctcaaagattcctgggggatcacaggccccagaggggccaacactattgtcatcttaatactaagatgttaaaaaaaactaagatgttatctgccctttccactcctattctctcatatgcgtacagtggatttttccagaggctacgtgactggtaacaaagccatcactccaaccactaatggaatgtgtgcttgtatagtcttgcgttatccagattttctaagataatgatgctttagggtacaaatatgtctttcagagattaactcagattgatctccattctgtgcttttaccagtcattaccatttacacttgctttaaatttctgtaacctgaatattgccctatataccattactattacttcattaattctgaagctttgcttatgcctacacaaaaacacaagcagtaccttttgtggtcttgttttataatacaacttttcaaattttcaaatttttctaaatttttaaattgtatctaaaacttaaacagcctttaataataaacatgactttaacaatattttattctcaaataaaagaaaatgtataattcttttatatttaagaatggatcatttctttaaaaaggaaagactaggagatttgatttctcaacccacagttgcaccatccgtgtctaaagatgctgaaaatgatgaaactgaccacatcagtgagttatcgaattcatgaaagggaggagtctactccaaggaaactggatgaaactgtaaataagaaacaaaaatatgatggaagccttcctacctctagctttatagatgttagtaatttaccttattatatcttatgcaacaaggtattcttctaaagattttttatttttaagtaatttctgcacccaatgtgggactcaagctcacaaccccaagatcaagagcagcattctctgagtgagccagacagatgccccaacaaggtattttttttcttgagcttcatttttttttttgtaaatttccttaagtaacctctacacccaacacgtgcttgaacacaagaccctgagattgagtagcactctctactgaatgagccagccagatggctccgcacaaagaagctattttctaatattattactaaaatatcattctgagactaatcaaagtttaaaaaaaaaagaattgaatattttatatgtcacaatcaagtgggatttatttcagggatgcaaagatagttccacatatcaatgtaatacactacattaacaaaataagagtgatatgatcatctcaatagatacagaaaaagcacttgacaaaattaaacatttcattataaaactctaaacagagtgggtaaaaaaagtacatacctcaacataatgaaggccatattatgacaagcccacaactaacattatactcaaaggtaaaaaatgaaagctcttcctccaaaattaggaacagaacaaagacgctcactctcaccacttttattcaacatagtactggaagtcctagccaaagcacttagacaagaaaaagaaataaaagggatccaatttggaaaggaaaaagtaaaacctacactatttgccaataacatgatcttatatataagaaaaccctgggcagccccagtggcgcagcagtttagcgccgcctgcagcccagggcgtgatcctggagaccctggatcgagtcccatgtcaggctctctgcatggagcctgcttctccctctgcctgtgtctctgcctctctctctctctctctgcatctctatgaataaataaataaaatcttaaaagaaaaccctaaagactccacaccaaagttagaactaataaatctggtgaaactacaggatacaaacaccatatacaaaaaaaaaaaaaaaaaaaatcagctgcatttctatacgctaacaatgaactatcagaaaaagaaattgtgaaagaaaaatcccatttccaactgcatcaaaaagaataaaatacctaggaataaatttaaccaaggaggtgaaagatatgtacgctaaaaattgtaagacattcatgaaagaaagtgaagacacaataaatggacagttattccatgcttatggatggaagaatattgttaaaatgttccatactaccaaaagcaatctacaaattcaacgcaattcctaccaatattccaaatgacacttttcacagaataagacaatactcctaaaattcacatgagcctgaatagccaaagcaatcttaggaagaacaaatcatgttccaattccaaactatattaccaagctatactaatcaaaacagtatgatattaccatcaactgttggcagatacaaagatcaataagacagaatacaatctgttggcagataaaaaatcaataggacattatagggagcctagaaatgaacccttgtgtttatgatcaattaatttatgacaaaggagccaaaaatctgtaacaggaaatgacagtctcttcaataaatggtgctggaaaaacttgtacagccacatgcaaaagaatgaaactgcaccactaccttatacacaaaaatcaactcaaaatgaattaaagactttaacgtgagacctgaaatcagaaaactcctagaagaaagcacaggcggtcagtccggcaatgattttttaatttgacactacagcaaaggcaacaggcaacctggcgggctcagctggcagagcatgagactcttgatcttgggagtcatgagttcaagctctgtattgggtgtacagattacttagaaaaaaaaaagcaaaaataaataaatgtgactacatcaaactaaaaaaatgctcctgcagagcaatggaaactatcaacaaaatgagaagggaacctaccaaatgggagaaaatatttgcaaattggatatctgataagggtaataccctagatatacaaggaactcatacaattcaataacacaaaaaccaaaaaaaaaggggggggaagataggatttaaaaatgggtagaagagggtgcctgggtggctcagtcagttgggcatctgctttcagcttggatcatgataatgaggtcctgggatccagccctgcatcaggctccctcctcaacgggagtctgcttctccctctcctctgcccagctcccccaccttggcttgtgcttgctccttctctctcagataaataatctaaaaagaaaaatgggcagaaaaatcaaaatgagatatcacctcacaactgttggaatggctgttaaatgacaagacattaaaagtgttggatgtggagaaaagggaaactttgtgtgctgctgttaagaatgtaagttgattcagccactatgaaaagcagtacagaagttcctcaaatagggatccctgggtggcgcagcagtttggcgcctgcctttggcccagggcgcgatcctggagacccgggatcgaatcccacgtcgggctcccggtgcatggagcctgcttctccctctgcctatgtctctgcctctctctctctcactgtgtgcctatcataaaaaaaaaaaaaaaaaaaaaaaaaagaagttcctcaaataatgaaaaatagaactaccatatgatctagcaatcgcacttctaggtatatatcccgaggaaacaaaatcactacctcaaagagatatctgcatgcccacattcactacagcattatttacaacagccaagacatgggaacaacctaagtgttcaccagatggatgaatgattaaagaaaacatgacacacacacaaagaggaatattattcagccaaagaaaagggaaagcctgccgcttgcaacgtggtcagaccttaaaggcatggtgcttagtgaaataagtcaaaaacaaatactgtatgatctcacatgtggaacctaaaaaaagaaaaacagagaacagattggtagttgttggcagaggtggttgtgggaaggtgaacaaggtcaaaagctacaaactttataattataatatattataattatattataatataaataagttctggggatgtaatgtacagtatggtgactacagttaacagtattttattgtatacagttattttaaagttgctaagaaagtaaattttaaaagttctcaatatcagaaaaaaagatttgtaattatgttacagcagagaaacaagacagacatcaccttaaccaatcaaggttaacatcgccagtaataagatagactgatatcaggtaccttttggtatgatgctatgatgcattgacaaggacatagcacttctgtgatattaccgccaaaaatgcatggcctcaatctaatcatgagaaaccaggaggcccaaattaaggtacatgtgcgcaatgctgccccacatattctctacgggactcaattctcgtcaggggccccaaaacatagcctcaaaagacacagaatctgtactgtatagcatatatgaaaactaagctatcaattatctaagggtatttggagatttgtaaatttaggagatttgtaaaaaggtaaaataccaccactcttttcactaaatacttgattaatgagcactgggggaagagggtagcaaatggagggcagtaattcttttttttttttttttttttttgagggcagtaattctttaagatggttggcggtcatattttttaaaatgtgtactttttgaaaccagagaaagataaaacagtaattactgtgtttgccaatattaccttcttctgtgatttaacaatatcatttacaacagagaacattaagtaaatgctttcatccattcaatgggcacatagtcattaaaatgtttacgctaagttcagattaggaaaaaaatttgtttataataatgtgaaaaacaggacgcctgggtggctcagtggttgagcatctgcctttggctcagggagtgattctggagttctgggatcgagtcccacatcagactccttgtgaggggcctgcttctccctctgcctatgtctgccttctctctgtctcgaatgaatgaatgaatgaatgaatgaatgaatgaaatctttgaaaaaacagtttataaaactatacttgtcaatcactttttttttttttttaccatttttgttaagaaccgaaaaccataacgattaaagaatttcctccctatgttttagaaattatttgaaggtatttaacctcccaacaaccatgaacctgctatgtataaagcaccatctaggcaccagggaagatgaactatgagcaggacagacacattagaactctgataacttacaacctactgggagcaaaagagggaatgttttccaaattcactactgtgaacatgaactttctttataatggaaagaagactaataaaactgccttcaaaaaaatgtctctggcattcaaaatttgccaaaaatatccatgtttctgataaattcagttttcttcccacaacacatatgtgctggctctgtgatgcgtgatcagctgcagccaacggtgacaataagcaatggatgctgctaaagtcagtatagattatgtttctataattgtatcacagcctctcaatccacctttgttttattttgttttgaatgctggtgctgggagtcagctttagaaatgtatttttattcaaatttcttcctttccacttatttaactccttcttgtagatctgtcagggaaaaaaaaaacaaaaaacaacaacaacaacaaaaaaaaaaaaacctgtgttcttttctacctttgtacgcatttcaccagaaatagcacagtagtcagatttggatgccctttcggtttcagttcccttatctcactgaagtggttgggtaggttctgcctaaggttggataggttctgcctaaggttacttccaggtttacaaatttcaagattctataaccttaggtcttacctctctccataacgccctttcaaagtacactcacacaggtccatttactgcatttaaatactttttaaagtttattccattaaattccttctttcccacttcctaggtttttggatcacatgccatactgaagtctatctttgtgcagctgtattaggcccttatgagcaggatttgatttttttttaaggtttgcacaatctgtattaatgcagtaaacttctactcacccatcaacacccagatttactcctttcccactatttccaactttccgattcagcattagtcacctcgttcattaagcattctgtaccaggttctttttttttttttaatttttatttatttatgatagtcacacacagagagagagagagaggcagagacacaggcagagggagaagcaggctccatgcaccgggagcccgacgtgggattcgatcccaggtctccaggatcgcgccctgggccaaaggcaggcgccaaaccgctgcgccacccagggatccctgtaccaggttcttttataacacttttctcactacatcataattatctgttgaccactgggattccttcagtggttcctgttttagtaacaatggctaacgattcttgagtactcaatatgtacctgggaagggctatcttccctcatacaagttccacagaatttcataaattaggtaccatatattcccactttacagctgaaaaaacggactcttggtcaatttcctactcccctgaccttattattatataagcattatagctcctgaatcagtccccaaccttgaaacattcctgtttcatttcctctccagctcctacatgcaaagcaatagggaaatacagaaaatgtaagcactataaattctatcctctctcttgaagatggaatttaagtttccagaattctaaaacactttcctggcagcctgggtggctcagcggtttagcgccgccttcagcccagggcctgatcctggagacctgggatcgagtcccacgtcgggctccctggagtctgcttctccctctgcctgtgtctctgtctctctgtctctctctctctgtgtatctcatgaataaataaataaataaataaataaataaataaataatcttaaaaaaaagaaacgatttatgaattgctttgagtttatcttgctaataaaatataaattaaaatattaaaaaaaataaaacactttcctgcttatagtttatcctctgtagtgctctacacacaagcaggcccacaactgcctgtgaggatacacaccattcgacctccaacattataaaactatccttttgatcccaaccccaccagtctgccagactttttcttgcctctgaaactcctatgaccagaccactttcagtatatacattttacttctcagaaagatggtgccacctagaagttttctcaaattcacatcaatataactcaagctctaggtttttttcttttatccacactttaatctcagatgaaaatgtacttctttcctaaaaacctatcctaatcaacccaaatccatgctggatccccttctacacatacccattcccctccttcccacctatctaaatcctatcctttcctaaaacccaagattgactacttcagtgttttgtctccaacacgaagtccctccaaagtacagtctctctacactttctctaactgctccatgtacttcaagtcctatttcttccatttttcaatctgcccccacataagacacataagagttgcttgttcaactgcactgaaatggctaaaggaaattaaccaatttagaaaagcattcttcctggagaccagggaacacatcccattttaaaaatcaccactgcatctagaatagtactttatataggtaaggactcaataaactcttataggagactataatgtgtatttcaagaagcatcctgcggttttcataaacttgcatcattaaaaaacatttttggggataatggctggctcagttggtgtagcatgcaactcttgatctaggggtcaggagtttaagccccatgttgggcgcagagattacttaaaaattttttaaaaacggggatccctgggtggctcagcagtttggcgcctgacattggctcagggcatgatcctggagtcccaagatggagtcccacatcgggctccctgcatggagcttgcttctccctctgcctatgcctatgcctatgcctctgcctctctctctctctctctctctctgtgtgtgtctctcatgaataaataaataaaatcttaaaaaaaaaaaaattcgggactccacacatatacatttcttctagcacaatgcattagtgaggaggttaccttaaaaactacccagggggtgcagtagacagggttcttggactacaagcaacagaaaccaagactggccatgtgtagccaaaggggatgtactgaaagaaacatcaaaggctcagagaattggagtggcagggacaggaaggccagggttggaagatgggcccacatcatggcatgccagggctggaaacaaaagccacagcctgaaactaaaacacaaacatctggttagcatacagccgctgtctttcccctgctctccctttggcgtcctcaggacccagactcaaagcaccgagccaccaactaatgaagcctgagtcctgcatccacactggcacaccagagaaggaagctagcacattggcccattcagttcttgggatgctagggtgggcccttcctcctctccaaaggaggatttctccaaaaataaaagaagaatgctctgaggaaagaggtgctgaccagagaccctagaaataaaaagcagttatccctcgcacagatatgcacccacttgcaaagtcactcacagaatgactccacaaacattctatgccctgattttctgccagaaaaatcaatcatttggtagactctacatccctacaccatagcccacaaactgttctccagagactctaatgtgtatgccactgcctcagctgcccttggcctcttctatcccatctgaccacagcagatcctcccccaggtcccttgaccaggtcctatgccaagtccttcccagacatgcaccttactaagccaaagaattcatctccccacttctttctcccacagcactatatttctagtttaaagaatttttaagttttattataaaatcaagctacagggattattttaagtaaaattcaaggtgttaaaataaatcacttttattttatgcatttaaaatattttcttagggatgcctgggtggctcagcggttgagcgtctgcctttggctcaggtcatgatcctggagtccccagatcgagtcccacatctggctccctgcatggagcctgcttctccctctgcgtgtgtctcggcctctctgtgtctctcatgaacaaataaaatctaaaaaaaaaaaaaaaattcttagacatgctataaagtacgactttttaatggtacaaagtattaatatcatgaaataaaaagtaagttcaattctgaaggattttcctggttccagtggcagctccaaggtttcaaactggtagggttctctcttgagcctcttgttttcaagtctttgaggatgagaagtgtctttattcctctcccagacactgggtgggttggaccctcttaatttctctttctccaagtacagatctgggacagtgtgagggggaggcaagctgaggataagagctttctttatccagagaaaggcttctctttctgttttctctgtcaggcttggacatttgcccaaatcatggtagatgctccataaatgatgatctgaggaaaggggaaggaaagatggtggaccacttaacagtgccaagctcttacaaacagggcccaccatcaccaagtactctgccctgtctggcacccctcctaacactataattgtcataaaagatgaaaacagagaatgactgaagtcctctaaggccttctagttcaaatatcacactgtactgcaactgctggcttagttatgtatctccaccacagatcgtaagcaacgtgaaagcaggggctgtgttcacctcattcactgtaatgcagcacagaacccacagctcaagagatacaaactgatttaattaacaaacaaattcccataactttcttcctaccacaattcgctataagcccaggttgctataaagttagaaattgccttttccttagctttatatttacatagctgacaccgaatgttaacttgtgccaggcactggactaaatgttctatatattaagtgatttcacttgtcctccaacaacaataaaatagagaggtactattattgttaaaagtgagaaaatgaggcaaagagatgtaaagtaatttgctcaagatcaccagacaagtgagtgtgacagccagggatccaattcaggtatgtctgactctagggcctaagctcttcaacactacagacatggagactcaaacgccattttatgggacctgggcagggtgcacaagagtgtgaaatcagtcggaatctctgacactgactagtctaaagaggtaggaatatttccatctccacaaagaaatatgcactctccccatttttcttgaaatttacatgggtacaagaaatctttgaccttactcttaactctaccttgagaaggcggtaacacctcagccaccccaataaatgttagcggtcactgggcctctctatctaggggaccacagggaatggtaaggactgtggcccactgaagaggggtgggcagtcagtccataagggtggccaccaatcagctctggctgcagtcctcacatagggaagctggtgtaatgaggccagatcctctggtttttcaagaaaaaaactaaagaccagattccttattcaaaaattttcaaattaaaatgttggcaactaattttttttaaattgctttttatcatctttcatcccacacacagccatgagccatcagtatgtggtcctcacacaaaacttcaaggcaaacagggttccaaaggcctctgactttccatgaggtcacccacctggcccaaagtcctccatctagaatacagttttgtcagctacccaaatctaaccaagacatctaggtgtggccctacaaactccctaaaacgattccgacactccagttcattttcacagactcctccaaatactcataaacactcctctccatcgcctctttaattagcttgcattttacattctacactgtatcctgccaacagctcacagctcctcaggagctcacatcctattccatacatcttaacctcctcagttcggagtattctttagagacacactacttctgtaatttttttaaaaaattcctttttgaaaaaaaaaatcactctagtatctggcagaaggatgaccccaagctatgtccttattaaatagttgttgaacctttgaaaacaccatagaagtataattaataattaatccagaaactctctggattattttttctgactcattctaccaataaaatctaaaagtttcatctcattattattaaaagcagtctacctaaactgcaaaacctcccgggaaaaaaatcagcactgcagtgagaggtgcaaaagccctgagtcagggctcagcacatttagtaagcgctaatttactaaattgttttaagtctaacaaccaagttattccaagaggaagaaaatgaaacattaagtaattaaaattccaattattcaaaacattaattcaagctactcacatttacaaagtgttttataaaagcaggtattttgcctcaagaagttcactagaattcctgaatattcgaagaaaaatcattatcctttcattactctttctttttttttttaaagttatctctacacctaatggggggcttaagctcacgaccccaagatcaggagtagaatgttctactgctgagccagccaggtgccccttcaggcagttctttaaaaggattttactgtggggtgcctgagtagctcagtgattgagcctctgccttcagctcagggcatggtcccagagtcctaggatcaagtcccacatcaagctccttgtggggagtctgcatctccctctgcctgtgtctctgcctatatgtctctcatgaataaataaataaaatcttttaaaaataaaattttaaaaaaaggactttactgttctatgaacaacgagaactaagtgtacacaaagaaagtctatttaagggaccatttctttttaatgtatataatagtcttgtcttctgtacagatttgtttccacttgctttagatttaagtttttgttattttgtaataattttcttttaaaaaaaaaaaaaagattttcttttttcataagagacagagagagagagggagagagagagacataggtggagagagaaggaggcttcccgtggggagctcgatggggcactcgatctcagcactccaggatcacgacctgagctgaaggcagatgctcaaccactgagccacccaggcgtcccttataataattttctttacgtggagctgaaattcacctgctttatctccttttggaaatgctcacaaaacacacagacgtaagataatgttttatgctactcaagttattaatttcccgttttgaaaaagaattaaaaactgtcctaaactgcctaggaatttttaaaagtatatttggataaagcacacaaaagatatgatcttacctgcctcagatatgtaaccagatttgcacacagcccacttctggttaactgcactaagaaagcagcaggcagcagcacacacaacatgcatgataaaatgtcgagaagcagaaaaaaacaacccactcatgtttgctttgcaaatacttttcgtgctcacattggaatatggttgtatcattctagtaattcttttctatttcataaataaggaggttgcactgtgatgatcttcttcaatcaagtttcccatacccagctctgggatggcattttgggggactgatgcaaggggatagaaaagaaggttaaggcacaggctgggagaaggaaaaatcttcgttttcttccttcttgagagcctccatcactactcacaaagcatacatcacttttgatacttctggtcatggaatgtgtggggttccctctacaccaaacaggtctctgcaaaaccagctgggtgtcctacaattttactccatcctgacgctatctctggatgccatcatctctctactcagagacagagtcagatcacacaggttaagagctcagtcccacaagtccaccaccacccttcccaatgccagtcccaagcccccattactaccaatgcttctgaccaattggctacaaatgagaggttccaacagccccctctgtgggctcaatgaatttgccagtggcttacaaaactgaaagaaacaattcatgtttgccaatttattaaataatatgataaaggatacagatgaacagccagatcaagagctacatagggcaaggaacttctggctccatggaggtgaagtgtgtcatcctcccagtgtgaatgtgttcaccaacttggaaattctccaaaccctgtactattgggatttttatggaggattcatcatgtaggcatgatgggtcattaactccattttcagcccttctcccttctcaaggcaatgaggggcagggctcaaaattccaagctgctaatcatggcttggtctttctagtgactggccttcatcccggagccatccaggaacccacccagagttgcctcactggaacaaaagacactcctatcatccaggaaattacatcaggagccctgtgtcaggaatagaggtcaaagaccaatattagaacaagagatgctctcgtgttcttatcacttccgacatagtgagaatattaggagctctgtgccaggaaccaggggcagagaccaatacatgccttctattacctcaagtctctcaggaagagctgaaaagtcaccattccactcagaattctacctcctactcattccacagctgggacaaaagcatatggctaaaagtgaactgtttcctactactaccaggaaggtactttggcttgaaaggtcgactctgcgtagtgtaaacagcgagagtttagaaatcagcaagcccagtttgacccagacaactgctaagctgcttttcaggggcttgaaggccagttagacaagcagcttccacatcatagcactttcctgatacacacagcccactgccaacactgattctaatgcacacatgcagaccactccattcctagcagttccgcattccagaaggatccccagcacttaaggtaaccaaacttcaataaaattaggtaagtgctcaaaaactatactgcttaaatggcctgggttcaaacacatttctagggatgcctggatgtctcagcagttgagcatctgccttcagctcagggcgggatccgggatcaagtcctgcatcaagctccttgtggggagcctgcttctccctctgcgtatgtttctgcttgcctctctttctctctctctctcatgaataaataaataaaatctttttaaaaaaaaaaacatatttctaataaagatgttagttaaaaatttgccattaaaaaaatatatatttctaggaaaaactggcaaaaacctctattaaacaaaaataccccccattctttcacttgtaatgccctgcagtatatcttttataagctaacaactacctgaatcttttgttccatatcctttgtaccatttgaattttgtactgtgtgcatatactacctattcaaagtagcctttctgactaactaccctaataaagtgtaaagaaactttagggatttgtctttgggtcctttcagatttatttctttaaaatattacagaacaagggatccctgggtggcgcagtggtttagcgcctgcctttggcccagggcgcgatcctggagacccgggatcgaatcccacgtcgggctcccggtgcatggagcctgcttctccctctgcctatgtctctgcctctctccgtctctctctatcataaataaataaaaattaaaaaaaaataaaataaaataaaataaaataaaataaaataaaataaaataaaataaaatattacagaacaatacttttatctccacttgtacatttcttaagcacaagtttttttctaatcaactcttactgttctattaccatcctgtcaccatcacttctattcctcacatacaagggaaagaaggtggtttcatggatattactagtttgtttgctgggttgctgtaggtggcagagtaaaggagaaccaggaaaactagaagagtaacaaacctccacaggaaatggtagcctcccacctctgcaacatctcccaccactctcctccacttggccttcagccactctggccagcttcctgcttttcctccttgccaaattcattgccattaggggtctcttccctctgccttgcttttcagagactactggaccccaatttgccaacacccccacccccagtctcagtcccatcacatatttgtttcctgcccagtatcaccactgcctaaaatcaagttcactaatatttttgctcatttaccatctccctgcatctgatatcagaagcttcacaagagcaagagcttccatcctgtcttgttcaccactgcattccaaaaacagcaactggcctagaagcaggtactcgataaaagtttgtacaaccaaaaaaaaaaaaaaaaaaaaagtttgtacaaccaatgaataaatgaatgaatgactataagaatgaacatttttcagagcacctgggtatctcaatcagttaagcatccaactcttgattttggctcaggtcatggtctcagggtcatggggtctagccccacatggagcctgcttaagattctctctccctctgcccctaccattgtttgtacatgtgcacacgtgctctctctcacaataaataaaacctttaaaaaatgaagggttttcctcactcaaaggcttagtaagctaggaagcaaggatttcaagaagactgggaaaaactgttgacatccttgagcttccatgttattttaggacagaaattctcaaactagattcaagaagttttcttgggtatttggaaggtgttactcagcaagttgactttgtttttttttctgtttttttgttttttttttttagcaagttgactttggatgcatatgttttattactaaattttaagtttggggactttttttctaaattcaattacttattcttcttttatttatatattatcttcttcgcctatgatggatcctttgttccatttcatacattaaccaccataaatcaaatgcttcaagactccatactcacaaacttgacatcgtgtctctttcactttgacctagataaagaataaaataatgacaacagaaaacatttttatgaccatccttatcaaccttcatttgcaaattgattactactaactaaactttggaatccagatttgatatacattgttggttggctacaaccactatggacaagtcattaaaatagtatctactacttgatggtagtttgttgatgtattttcttatctactagtaaaaggctatcagcaaaatgaaaatcctttttcctcaggtattgtatcactaacggttaaggatcagtacattttatcaactacccaacacaaatcctgcaagatggcacagactcacaagttcaacatgtaaaagaaatcctaagtgtcctattatgaaaaaggatccactgagactcaaaagatttacaaccgaatacacatacactcccactgggctgatactcaacattattatcaaacaccctgtcactaagacactggaaataagagctagaagacttccctgaaacccattactggtaggcactagcattcagtgtattgggggtattttcaattcctctactagctgtaaagatcccacaaccctgagatcatgccctgagctcaaggtagacgctcaaccaatgagccatccaggtatccctagactataaacttcttcagggacaatgtgttcattcattcattcacatagtcaagaaataatattaagcatatactatgttctcatcaccaaggatacaggagtgcataagagacaaaaatctctatcctcataaactaacttgtattctagtgagagaaaacaatacaactaacaaatgggaatataacatgtcttcatgatatgtgctgcccagaaagaaaaaagcctaggagatacagtgacaatggactggtattattttctataacatgatcattaaagacttgtctgatgaggtgaaaaccaagcaaagaaaagggaccgataatatgacagagaaacagcacagtggccaatgtggttgcaagaaagggatgagtaagagggagagtaataagagatgaggtcagagacatggcaggggacccaaacatccagaaccttagaggtcatgattaagggatccctgggtggcgcagcggtttagcgcctgcctttggcccagggcgtgatcctggagacccgggatcgaatcccacgtcaggctcccagtgcatggagcctgcttctccctctgcctatgtctctgcctctctctctctctctctctctctctctgtgactatcataaataaataaataaataaataaataaataaataaataaataaataaataggtcatgattaagacactggattcactgagaataccactggggcagagaagtgacatgatctgacatctatgttggaagaatcactacagcagctatggtagacaagactagaagagtgagagcagaagcaggaaaaccagttaagaagattcagctgtagtccaggcaagaggcaataatgggttaggctagaatagcacagtggaggtggaagagagaaggttaggcaggatctgctgtaagattagatgtagtttaggagaaagggagaagtcaaggatggctccaaggtttctaacctggagcatggatatttcctttactgaaagaggcacaactaattaggataagcaggtttctgttgctgtttggtttttggtggatggaatcaagaattcagtttgggtattctaagtttgagatgccgagaagatatccaaatggaaacaccaaatagcttgcaggatagtcaagccttgatttcaagagagaaattagggctaaaaatacagttgaaagttatcagtataaatacagtagttaaagatgggactggatgagatcacctactgtatgagcatgtgtaggaagtatggggagtggaaccggttcaaagattgtgtccttgtgcactacaataaaagaattcgggaaaatgagaaggaatacactaagaaggaataaccaataagaaggggaagaactagaaagatgtcctagaagcaaggtaaagaaagtatttcaagaagaaagtaatgatgaggcagcaaggattcagaactggccactggttttgttaacttgttatcttgaagactgattccagcataatcataaaaaagagtgcctgactggaatgagttcaagagaaatgggaagtcggaaagtggagacaaggaatacagaaaagttttgctgggaactggaagaaagaaatgggatggtagctggagggaacatggggtaagggagcatttcttttaagatggaaaatactttaccctgctcagctgggaatgataaagtagagaaggatttggtaatgaagcaggaaagacaggacacccataggacacccacccctgctgggctggcaggaggggatgggcacaaatacatagcagatagaaaagctgactttatgagggaccatagacttatttaccagtgtaaagatacactgcaggatcttgcacagagactagtccacaatagggccctcaaaaaatgagtaaactaatgtattcttgaacaagggcccttcctttttggactaggctatgaagaaaatgagagattgcttcatacaaagtagatatgcaacccgatatttactgagaaatgagaatcactcaggagcaaaaaaggttaaggcaaagaatagaaaagaagaatggagattgcagtatgatttcagaccagaattcacatctcaggaagctaaatagaaaaggaggtaatgggaaaaatgtttaactgactaaccagtattactacgtaagcacgagagagcacacacacaagaagccaccaggaaaagaatgagagaaatgagcatcagtaatgtccaatcagatgactggatcaatgcactcatcatgatcttagaacaatgtaatactggacaatgaccagagatatgttacaaaaagactctccaaccagcctgggatctactgaaagctctttgtcatggttattgcctctgggattgctgcctgtgctttactctcctctctagagcccaggagaaggtgtggtctgccatgacgtccacctgctcctctgggacattcttactaacaaacactcaggccaccagagtccctgcccactgaggatcttcaatgtcagtcatctccccacccaccctcgtgagttcagagaaagtgcgaagcagcagtcccttgccaagagatggaaaagctcaaccaacaaacctaagacccttaaggacagttttgacctttctattattttttattttttaaagatgtatttatttattcatgagacacatagagaaagaggcagagacatagaaagacagagaagcaggctcctcacagagagcccagtgtcccagacccagaatcacgccctgagcctaaggcagatgctcaacagctgagctaccctggcatatctatcctttccttttaaaagcagttttaatacacagagaaatctaagatgatcctatcaatactcgtgttttaccttgagtaaaaatagacccttaggcgcagctttaactttcccaagcactgtgacatcatctggtgtccagactgtgtcactggcctttctaggagggtatttcacactgctagatatttcaactgtctaaaatgcctgttccactcccccactccactctggggagggtacaagaacacaagcaagcccacctctagtgtccctcacttcctgtcatcacagagcctcaaaaaaagagggataagggaaaaatctcaaccggaagtgctttcagagaaccaaagacaaacaatatgacaaagttgattgttattgtcacccagtccagaagaataaaatcttactcaagaagccagtttcagtcttgtatactgcttatgataaaacattaactgggaagataaggcagactaaaaatacaaatgtatacttacttgctaatctttgtaggtctaagatcttgtcttgaatctatcattgggcggctgagttgtctttcatataccacacccatcatgcatgacctgttttccagttcaggtttttaggtttttttttttttgttttgtttgttttttaagatttattcatgtatttgagagagagagagcaagagcgtgctcatgcacacatgcaggggatagggggaacatggggggaggggggcaaatctccagcagacaccctgctgagccagacacggggtttgatcccacaaccctgagatgacctgagccaaaaccaagaatcaaacgcttaactgaatgaaccacccaggtgccctctctggtccaggtttctataaagaaaaacgaaaacctgaaaacattcatgaagtgatctatgtgcagagtccttttagacttttaagactcttctccatccttcgcagtttgcttatccatataattgagcagtaatttcttttaatgacttgaaattattgagtcattccaaagaatttagaatactcacaaaaccattatttttgaactcaaatctcacatgcttatatcatatttaattacactacataattacaataacaagtaagatgaacatacacaaatacaggaataaatacaactgactctatgtaagcacaggactgattgggttgggggtgtatatgagacccagtggctcacagaataacaagggtattcagtataccaagctggtttaaatggagattgggtaagagactgtctactgtgtatcagtaggttcaaagtacagtaataaatatgttatcatgaatgccctaaacctaaaggttttaatttatcaaaatgttgataacaattagtaaaactttgaagtggggggagtttcctgctattgattcttgtttactcacaggaaaagcagtccaaggtctgacggaaaggaacacactctgttcatgctgttgggcctgttcttctgttgccccctctagactctaaactccctatatgtaacagtatctcaataaacttgctctgtaaacttgccaacttgccaaatatgttcacacatcctaacctggatcagtgtttcaactgtcactgctggcatataaaatcttctggggctgaaaaaacagaatgttcgaaggtttgattccaatattttctatctctttctctttacattgtatgtatgtttcctgacactggttagttaagtttattaaccagggtctctttattcttacattactattgtattcatgctaacagtattctgtaagctattctatcttgattaaagccattgcttcccattaaaaaataaaattgggttgaatgtcctattgaatttgaatttcacattcccacaatgtgtggcagttaatacttccagtttctggcacttctattgagaacataaaagttctcccggaactaacaaattacttcccttctaacacaattatgtaatctgagagctgaacggcaccctagagattattttgtggtccaaaatccctcccaattaagggatcccatcaaaaagtactcaacttttttgggcaggaagggatatttatctttaaatctcacattatagaatgctgcacccatagtaggctcttaacacatacttgtttaattgaactgaacaagtctaaaatgggtgcatttcattaattttcttgtcctttctgggctttagctgtaacatccaccgaatctgtaattaaaaatttgcatgagggatccctgggtggcgcagcggtttggcacctgcctctggcccagggcgtgatcctagagacccgggatcgaatcccatgtcgggctcccagtgcatggagcctgcctctccctctgcctatgtctctgcctctctctctgtctgtgtgtgactatcataaaaaataaaaaaataaaaaaataaaattcagattattttttaaaaatttgcatgaaacaaataaataataaataaaaataaatttaaaaatttgcatgaatcttctgctcattaaccaatgatcaaaaagaaattcaagagagaaaactccacaatcagccaaatgtcttaacattaagtctgttaatgttagtaaataacaaaactaagaaaaaatagaaaatcaagtcttagtttgcttatgatctatgaagtttccaatttatccaaaatactcacatgttctcaatttcagtatgatttttttaaacaaatagtcttgcatcattcatacaactaaattatacacccttctacttataattggggtgctcacagacttaaccacagtactgtagtaagacatgttattatgctaattaattttccctccagttaaaacagactgtgatcccatctgatttcctgtaatatgatatgataatgaaaagaacaaagcctctggagcagtaaacaccaccaaaaattttactttactcaagtatatattccaaaactgcatcattcacagcatggccctgcttagtaccccattacaatgcatctgttttggggacttttaaaatatatgataaaacacgaagtatacatttccaaattccctctccttctgttttgctgaaagggaacacacacacacatagtccctcaacagcacaattactgcttgactaatttttttcaggcaataatttaaagtcccacttcctcctaaacatctctggacagcaactcttggcaatccatctgtctctttcatcacagcttcttttcataactaacgggtcaagttcctttccccccatttcaacacgatgcactgtacttgcagccctgccactatagcccgctgctgaatgccagaatatagcatattgaatttcactgtccttcattgtttccagtttaactgccattttaccaccatgcacaggagagaaacgctttcccacaggcatcttatgaatttccaaagcagctactctttgtggatttacaaaaacgtttgccttctctaaattccctttatcaccacaaaaacggctctggcaagctgagattttcttttctttctttctttttttttttttttttcttttaggtactccatgcaaaaaagaaactgattctaagcatgtccattttgctagcaaattcaatccttaagagtttccgatagggcaatgtcagggcacagatcttaaacatggcttttgggcttcccaattaaaatgaagtattttcaggtcataaagattctcttatcgaacgtcctttcttctcagctacaccagaaaggctacccagcgcattgtaaaataaacaaacaactggctctggcgtctgtacaacgccctaaatctccccaaccacccccatgggctcacagacacacgtaacccctcggccacccccaaacctgctccggtagtggactatttctctggcacaaagggccggcctgcgcctcgtgcacggcggcctctgcacacatgtgcgggctgacaagtgcggggccgcccttcctggagccgacgccggaggcccggccccgaggccacacgctgtcccgcacccaccgccttctcccggcggcccccggccccgtgacaggcggtcggctcccacgctcccccggcctgacccgtgctcaggccgcgcggggccacgctcggacccgctgcccctccgcccaccgtccgtcctctttcctccctcctccgctccggctcaaggaattccggcggcacttccttcgggccgggaggggcagtcctgcccggggcccggcacacccccggcccgcggccgcgccccccgcacctcggccggctccggcgacccccggcccgcccggccggagcctcacctcctcctcgctctcgctgcggaaacacaggcacgcggcccgcttcttgtagccgtcgccgtcataggtgcgggtctggttcgacttgagcttcatcatcctccgggcccgggtgggggtgcggtgcgggtcgcgggagtcgagggtggggagcccgctccggacggcggcgcgcgcgcgcgtccccggctcggccgagggaagcagggagggggagccgcttctccgctacacggctcggccgctggcccgccacggctgcctcattccccccggcccaggccccgcgccgccgccgccgtcacggctgccgtcgctgctgccgccacggccgccgccccctctgccgccgccacccccgacgacgaccgcgccgccatcttgggcgcgctgcgtcagcggcgtaaggccgcgcgggcctgcgggacggccgcgcgctcgcagcgcaggcggcgtccgggaatcgcaccctcccagtccgcgcggcgtaaacgagcgtctggaatgaaagggccgtgcgaacggaggcggccgccacgccgggagcggaggggtggggaaggcggggcgcgcgcggaggaagtcgggggagggcggggtgcgggcgcggggtcgcccggggccgccgagaggtgcctctctagcctcggggtcgcggagggggaagcggggacttgcccaaggtcgggccgcccgccttggccttgccggttctctgggagcggggaaggggaaggtttggaggaaaaagccggatgcggttaaacgctgtggagcgtccacgggatttacccaggatcgggcactgcgcggccccgggcgagaggaggctggagggaggggcgttgtgcacagagcctggacctccagagcgctgggagtcctgagcaccggggcaccaacgtattcatcccgcagcccttgacgggtgcaaagacagatgcttcctgttaaggtaaacaggagggccagacaaggaagatacatgtgtatgtgctctacacacataatgcaaattgtaaaacatccttatttctggcactaaacgaggactttatagtgtggacgtcagattctccagagaaaatatatagcaagacacaggagcaagggaaaatgaaatataacctgtgaatattcccagcagcccagaccaaacataataccatgcccattccttgaacgtggtgtaaaacctgtgcgggatttgtctgtgagttgcttattgcccttatttaatttgcttgtatttagcacataaaaaaatcaggttttgaaaccaagcctttgttggaatctcggttacatgttttatttgcttctattttttgtctggcaattagtcacttaatacattgcaaataatatcaatggcatttcacctaatcctagccacataaaatgtggaatttcagttaatttgggtcaatcttcatgcaatagaattcccaaaatcttggtcattttggttgcttttctaattttctcttctgccattaggtctctaaaaggaaagaaaaaaaaaagttctggctgtagaaatcctgtaacatgatcattgtcaaaattttgaaaaatacagagggcataaaaaactaaatcatgtatctttgagcacattctatagagatctgtagcctgtccccccccccccgtctttccccttatgttatcttttttttaaaaaaatacctttctaattactacctgatagcccatcatagggatgaccatcaattattttatattttcctcattgttagaaatttagatggtgtcctctgtttcattagaacagtaatgaatgtccctgtatataaatccttgtccctatttcagatattcctttaggatgaattcctagaggcagatcaagggggtaggaacatatttatggctcttgctacctcttgccaaagccttcccagaaaagttgtctgagtacaatcattccagcagctagacagctacatggtactatctgccactttattagggttgagagagcagaattgcaaatggtattccaggtctcagtataccagggtaagcctttgaacatgcttccctggtgtccagaaggctctaggctcttcttccaataccctcacctattccattatccctccccacgtacccagagaagaagccaaattatatttatcctttaaagctcaaaagttggggatcccccggggggctcagcggtttagcacctgcctttggcccagggcgcgatcctggagtctcgggatcgagtcctgcgtcgggctcccagcatggagcctgcttctccctcctcctatgtctctgcctctctctctctctctctctctctatgtctatcataaataaataaaactcaaaagttccctccttctgactgcataactgcctctatgcttcctactggcctgagtttgtcctgctttatcacattgtcacatggcattgtcactttcttttttgccaatctcatatttcaaatgtattgaagtcagagtctgtgtctcactcatccttgcttatttcactcagcaattttcccaggacctaacagaatcaaccttgaaaacattttattagtgaaagaacaactactgcccgtccagaacctgatcttgagtataaagcttaatcacttgtccacaggaacaccccacacgacacacctaaaatctggtcctctgaatgaagatcacataacattatcctggcccagcatgtcagaaatcatctgtaataacttttagtgtgatcttgggtaaaatgttaaacaaaatacagaaaattgttttgtttttttgttttttttttttaatttttatttatttatgatagccacacagagagagagagaggcagagacacaggcagagggagaagcaggctccatgcaccgggagcccgatgtgggattcgatcctggttctccaggatcgcgccctgggccaaaggcaggcgctaaaccgctgcgccacccagggatccccagaaaattgtttttcacaagtgccttactctgtcttgttcctttaacatgcctttctctcctccctcccaggactaccttgtccatcccctcaagtcccccaggagcacctactgggtctgatctttgctcttgtacaagttacctattaatgcataacacatctcctcaaaacttagtggcttagaacatgaatcagttattatttctcatgatttctgtgggttaagaatcctggagtggcttgactgagcagtcctgctctgtgtcccttataaggtgagcaagctggtgttggctggtcccactgtcatctgaagacttgacgagctgcaggacccgcgtccaggggggctctctcacatggctgacaggtagaagaggctctgtgccctttaatgtgaacttcgtagggctacttgagcatcctcacaacatggtggtcagattcctctaaaagcaaacaatacaagactcaaaaactgaatgaattgcaatgccttatatgaactggccttgaaagtcacactttgttagtttcacagctttctattgaccacattagtcagcctgacttagtgtgggagaagattataccttgtaccagaaggcaaggatcactggggtcgggacacctggatggctcagtggttgagtgtctgctttcagctcaggtcctcatcccagaatctgggatcgagtcccgcattgggctccttgcagggagcctgcttctccctctgcctatgtctctgcctctctctctctcatgaatagataaaatcttcaaaaaagaaaagaaaagaaagaaaaaatcactggggtccatagttaaagctgcctgtcacacctcatataaaatttacctggtctctagttcattcattcattgcccatatatcccaggcagtgtacctaacagaggggaaggaggtaagagataatgcttgagaataggctacccttccaaggatgatagtgggtgataatagatttaaataatctttttttagaaaggattttatttttaagcaatctctacacccaatgtagggcctaaatccacaatcctgagaccaagagtcacatgctccaccaactgagccagccaggcacccctcaaataaattaacaaatacataattctaaaaatgttcaattttccaaaagtcttgtaggtaaagatctagtaaataacatttcaagtcccagggcaagtctagggaaaatttttaataggattacaaaattgaccatatttactcatcctttccatagggacagtcaaattttggcccatgttttccatctattttgatgctactatatttatcactatgtgattgtagctcatctcacctgaccaagcttttttccctgtttgcttcaaaagtagaataccatcagagaaagagaaacatttaaggaaaatctaacagttataaatatgaaacagcttcaaaatacatgaactggggtgcctgggtggctcagttgatggagtgcaactcttgatctcagggttgtgagttcaaaccccacatcgagtatagattacttaaacagcagggcagcctgggtggctcaggcagcctgggtggctcagcggtttagcgctgccttctgcccagggtatgattctggagacctgggatggagtcccatgtcgggctccctgcatggggcctgcttctccctctgcctgcgtctctgcctctctctctctctctctgcctcatgagtaaataaataaaatcttaaaaataaataaaaaataaataaatttaaaagaattaaaataaaataaaataaaatactgaagtatacatagaacatgcaccaagatggaccacatgcttggtgtaaaacaatactcaataaattttgaaagatcaaaatctgaggtgcctgggtgcctcagttggttaagtgtctgcctttagctgaggtcatgattctacaatcctgggatggagccctccatcgggctccctgctctcaggctcagccaggagtcttcttctctctctctctctctgtgctatctctgtctctgtgtcaaatggataaataaaatctttgggaaaaacatcaaaatcttacagaatatgtttttttggaaaaaaacacttaaagaataactaagatatctttaaaactccaaatatttgtaaattaaacattctattcctaaataacccataaaacaaagaggaaatcacaggaaaaaattataaggtatctctaaatgaatgatactggggcatctacctggctcagttggtagagtgtgccagtcttgacctcatgagtttgacttccacattgggggtagagattactgaatgatatcaaaatttgtggagttcaactagagcagtgcttaaaagtaaatatatagctttaaacacatatattagaaaagaagacaaaaaatcaattatctaagttccaactttaagaagctagaaaaaaaccaagtaaattaaacccaatttaatcagaagatatagagatgcaatcaatgaaatagaaaagaaacaaaagagaaaattaacaacaccaagttagttctttgaaaatactgataaagttcgtatcataaggaagactgatacaaaggaaaagaggaaaaacaaattaccaatattagcaatgaaaaaagagatgccattacagatcttatagacatcaaaagagtaataagagaatatcatgaaaaactttaacaaattcaacaatttcaggggaattagacaaattcctagaaaaacagtttaccaaaaataacaaaatagaaagttggaacatccttatctatgtaacaaattgaatttgcttaaagccttctcacaactttagttaataacaatgtatcgatattggttgtgataagggtaccatatatatttttaatattattgatttaagagagagagatagcaggagcagggggaagaggaagaagcaggctcccctccgagcagggagcccaacatggggttcgatcccaggtccctgggattatgaccagagctgaaggcagacacccaactgagccatccaggtgccccaacaagagtaccatattaatgtaagatgccaacaataagagaaacagtggggttatatagcgactgttacaacttttctgtagatctaaaactattcttttttaaaattttttatattattttattttttgataaaaaagaaagagaatgaggtgaagggtaaagggagagggagagagagagaatcacaagcaggcttcatgcctagcccattgaggagcccagtgtaggtccagtcccaggaccctgagatcatgacctgagctgaaatcaagagttggacttaactgactgagccacccatgcacctttaaaactattctaaaataaaaagtctattaaaaaataataaattaataaaaaattaaaagctttcctacaatgaaaactctagtgtctgggatatttttggtgaaatccattaaatatccaaagaagaagtaataccaatcctacacaaacttccaggacatagaagaggaaagactacttcccaacttgcattataaggcaaaaataaccctgattacaaaatctgataaagacattacaagaaaagagttacaaacctatattcctaataatatagatacatacaaaaaagctcctgaacaaaaaatcagtaaatagaatccacctacatatacagtgaaatatatcatgaccaaagaagtttaatacaggaatgtaaggttaggggatccctgggtagctcagtggtttagcgcctgcctttggcccagggcgcgatcctggggtcccgggatcaagtaccatgtcgggctgccggcatagagcctgcttctccctctgcctgtgtctctgcctctctctctctctatatatatatatatctagcatgaataaataaataaaatctttggaaaaaaaaaaaaaagaatgtaaggtgagtttaactttacaaaaatcaaacaataacatgaacctcctgaacataatacaagaaaacaactgtatgatcgtcttgatccaggaaaagtatttgatgaaaaatgtttaataaattattatttcataataaaaactattagcaaactgggaataaaagtgaacattttgggggtacctggctggctcagtcagtggagcatgtgactcttggccttggagtcatgagttcaagccccatattgggtgtagagattacttttaaaaaaaatcttaaaaaaaaaagtaaggggcacctgggtggctcagtcagttaagcatctccctttgcctcagtcatgatcccagagttctgggattaagacccatgttggctctctgctcagcagggaagcctatatcttcctctccctctgccctaccacttacttgtactctctctcactctcaaataaataagtgaaatctttttgaaaaatgaattttttcaacttgataaaggatatccctgaacaacagctgacattatacctaaaggtaaaagaataaatgcttctccactaagatcagaaacagggcaagactatctcaccaccactactagtaaatattatattagagaacttagtgaaataaaacatgaaaaataaatacaaggcataagattgggaaggaagtaaaaccatcactactcgtagacaacatgattgtatatgtaaaaaaatccaaaaaaaaggctacacccaaatactaatacatattagaactaataaatgaaattagcaaggtgaaaggaatcaaggtcaatacataaaaatcaggtatatttgtataaccatcaatgaataattggaaaatgaaatttaaacaaaatataatttatgataatatcaaaaaatgtcaaatatctaggaacaaacctaagaaaaattgcacaagacttgtatactgaaaacaaatattgctgagagaaattaaagaagacctaaataaatgtaaacatataccatgtttgtggatgaagaacctcagtattgaaaagaatccatcctccctaggttgatatacatattcagtgaaatttctattaaaaaaagtcatcagattatttggaagaagtaggcacagtgattctaaaataaacatggaaatgaaaagggtatagaacagccaaaaaagtctttaagaacagaattaggggatttatattttaattttaatactttttaattttagggacatctgggtggctcaggggttgaccatctgcctttggctccaggcgtgttcctggagtcccaggatcaagtcccatatcgggctccctgcatggagcctgcttctccctctgtctgtgtctctgtctctctgtctctctctctctgtatctctcatgaataaataaaatattaaaaaatgctctataaaataaaaaaaataataagtcagacttcataaaaatttagatatttttgtttgcaaaagaccctggaagagaatgaaaagcaagctacacactggaagaaaatatttacaaatcacatatatgacagagaactagtatttacaataaagagttctcaaaacacactggttaaaaaacacacacaatttgattagaaaatggggaaaagacatgaataggcatttcaccaaagaggatatacaaatggcaaataagtgcatgaaaagatgttcagcatcattagccattagggaaatgtatattaaaaccatatgaaatctcactccatccctctgagaatggctaaaattaaaaatagggattaattgtaaatgctggcaaagatgcaaagaaactgaaacactcgtatgctgctgatggaaatgtaatttggtacattttaccaaattctctggaaaacagcctgacagtttcttaaaaaaactaaacatgcaacaatcatacaacccagcaattatactcctgggacttatcctagagaaatgaagatttatgttttcttgaaaacctgtacataaaattttttaaagatttatttatttatttatttatttatttatttatttatttatttatttatgaataaatagagagaggcagagacataggcagagggagaatcaggcttcatgcaaggagcctgatgtgggactcaatcccagggccccgggatcacaccctaagcggaaggcagatgctcaaccgctgagccacccaggtgccccatgtacataaatgtttatagcagctgcatatgtaatagccaaaagctgataacaatccagttgtccttcaatgaagaatagttaagcaaattgtggtgcatccataccatggactattactaagcaataaaaaggaataaactatcgaaacaggacacaatctgggccacctgggtggcacagtcaattagttgaatgtccaactcttggttttggctcaggtcatgatctcagggttgtgaggtcaagccacatgtcaggctctgcactcaggctcagtgtctgcttaagattccctccctgcttttcctctgcccctcccccctcaaaaaaaccaaatgaataaaatctttaaaaaaaaagaaaaaaggacacaattaggatgatctccagattttatgttgagtgaaaaagccaatccccaaatgttacatattgtatgattccatctatataacatttgtgaaataacaaaattgtagaaatggagtacagaccagcagttgccaagggttcaggaggctattggggtggggcaacattaaaaggcaatatgagagagctttatggtattgaaaatactctgtaccttgacttcacgaatagcaatattctggtggcgatagtgttttacgatattttactttcaaaataatagtttcgcaagacgttaccattaggagaaactgggtagaaggcaaacagactctacactattttttacaactgcatacaaatttacaaatatctcaaaattaaaagattaatttttctgaatgttcaattgtattttttccagctttgtggaagtacaattgaaaaaagtttaatgttttaaaaattgggcaaaagatttaacagacacttcacaaaaaaatatataaggaatagccaatgtgtaccttaaaaagtgttcaacagaggcatctggttggctcagtggttgagtgtctgcctttggctcaggttgttatcctgggtcctgggatcaagtcctgcatcaggctccctgcatggagcctgcttctccctctgcctatgtctctgcctctctctctctctctgtgtctgtcatgaataaataaataaaatctttaaaaattaaaaaattaagaaaataaaaccatatgcaatatgccagaatggctaaattttgaaatatttaaatgaaaaagactgacaacatatgttgttgagagaatgtggatcaactgcaactctcatccattgttggtggaaatgtaaaatggtacaaccacttttgaaaactgtttgatggtttctcaaaaagttgaaaatatacatatcatatgatccaataattccacttctaggtatttacccaagggaatttaaaaaatacatatatattcaccaaaaatttgtgtgtgtgtgtttttcaaagagttgacattcattctcattcattcatgagaatccatcatgtaaatccatcaagtaaaacttagcaacattccagaaggatattgataaccatcagtagaaggatgggtaaatgaattgtggtaaagctacacaatagaatattattcatccacaaaaaaggaatgcattattaatagacatgttaacatggatgaatctcagaaacattatgctgagtaaaataatccttacacagaatcatactgtgtaattccattatatgaagtcctagaataagcagaactaatctatggtgaggaaaaaaacaagagaacaatggttgctttatgggtatgggtgatggggattaactgggaagaagaatgaggaatctttctaaaaaaatggtaaaattctatatcttagaggttagggttacacaggtcacattgtcacaacccagtgaatgcacacttaggatttgtgtttcttatctgtgtaaataatattgacctataactaaataatatccttgctaaaacatttaggggaaacaaaaacatttaggggaaaaaaacttttaggggatagagtactgttgtctgcaatttattcggaaacgtattttattttatttttactttttttttttaagattttttatttatttgagagagagacagcaagtgagagagagcatgagtgggggtttggggttgagggccagagggagagggagaagcaggccgctaactgagcaggaagactgatgtgggacttgatcccaggatcctgggaccatgaccagaaccaaaagtagatgcttaactgactgagctacccaggcgcccatgtttttatttctttaaatatttttttgtttttaagtaatctccacacccaacatggggcttgaattcacaaccccaagatcaagagctgcatgctccaccaactgtgccagccaggagccccagagatgtattttaaaagtgggttgtgttaatggatggatatatggatgaatggatagaaagacagataagtgagaaattatgtaaagtgttaatggtagaatcaaggtggtgggaatgtaagtgttcaataaagaacttaacagtacatggctagattttcataaaatgctggttaaaaataaaccttgacttcaatctcactccatacacaaaaatttatttgaggtgataatagacctaaacataaaacttctagaagaaagtagagaagaatatttttgtgacctcaaagtcagtaaaaatgccttagaggccaagaaaagcacaaaccataaaagaaaaaaacttgattaattagagttttaaaagttttatttacttaagtaatctctatacccaacatggggcctgaactcacaaccccaagataaagagtcacacactccttgaactgagccatccaagcaccctgattaattggatttgaccaaagttatagcctgctcatcaaaagacaccattaagaaaacaaatagacaagcctggaaaacacatttgtaatacatatataaatgtaacaaatgtttggtatccaaaaataattttaaaatgtacacaaatcaacaatacaacaaacaccccaattcttaaaaaatggaaaatataattaaacagatggacataaaaatgtccaactaggggcacctgggtggctcagttgtttaagctcccagctcttggttttggctcaggtcatgatctttgggttgtgagatcaagccctacattgggctctgcttagcgtggagtcagcctgagattctctctccctctgcccttccccagctctctgctctctcgctctctctctgaatacatacataaataaaatctttttaaaaatgtccaaaagcaggccttccactcaggtcatgatcctggagtcctgggatccagtcccatgttgggttccccactcaatgaggagtctgcttctccctctccttctggtcttgctcctgctcatgctgtctctcaaataaataaataagtaaataaataaataaataaatatcttagaagcaaaaaaaaaaaagtccaacaagcacattaaaaagtccttaatgggcagcccgggtggctcagcagtttagcgccaccttcagccggggggataatcctggagacccagtatcaagtcccacgtcgggctccctgcacggagcctgcttctccctctgcctgtgtctgcctctctttctctctctccctgtctctcacgaataaataaaatcttaaaaaaaaaaaaaaaagtccttaatgggttgcctgggtggctcagcggttgagaatctgcctttggctcaggttgtgatcctggggtcctgggatcgagtcctgcattgggcttactccagggagccttctctttctgcctgtgtttctgcctctctctctatgtgtctcatgaataaataaataaaaatcttttttttataaaagattttatccatttattcatgagagactcagagagaggcagagacataggcagagggaggagaggcaggctccatgcagggagcctgatgtgggactcggtcccataactccaggaccacatcctgagccaaaggcagactctcaaccactgagccacccagaaccctaataaaaatctttttaaaaaaagtgcttaattaagatcattagttattgggtaactgtaaactaaaactacaataaaacacaagttcacactagaatgagtaaaataaaaaagacaacagcaaatactgactagctaggatatggagcaactgagacagtcacactattgttgcatagtggttgtacaatgaagcaaccacactgaagaactattttttctaaagaccttatttattcatgagacatacacacagtgaggcagagacacaggcagagggagaagagggctccatgcagagagcccgatgtgggactcgatccctggtctccaggatcaggacttgagccaaaggcagacgctcaactactgagccacccaggtgtcctgtgaagaactatttagaacattcttagcaagttaaaaacatgcttagtcctaggtatttacccaacagaatgaagacaaatgcttattaaaaaacttgagtagggatgcttgtagcagccctatttgtaacagcctcaaactggaaatagcccaactgtgcatcagtaggagaatggaaaaattgaggtgtatttattcaatggaattctactcaacaataaaataaaatgaactagagagaaggagcaggatgatggagtagtgagctcacatcctcccacagacaggataaaggctacagctacatgtagagcaactctttctgagaatgacccaaagactagcagaacaactcttccacagctaaagatacaaagaaaaagacacatggaaagggaggaggggcagagatgtggtctggtcgggacccacagcctcagcgcagtgacccacaaacaggagtgatatcatcacaaatgcagagggcctccctgaagagtgaagagttcatgtcccacatcaggcgcctctgccctgaagatctccaccagaaagatgagcccacaaaatacctgactcagaaataacagcagggcttgactctgggaaagcagagggccataagaagccaagactctgctcttaaagggcacttgcacaaacttactggctctgaatccagcacagagacagccatttaaaaagcatctgggccatataagaaggaaatttattgactaattttagggtatgtgccagaggggcaaggatctgtaggaactttctgtgggaataaaagcattagcagtcactgttaatctcaccctctttctacctagcaggcttggcactggtgggcataatttttgacactctccatctaccttgctagcaccctgccaggtattccactgcagacctgtcctacccaacctgcccaccccagcagatgcctcttcaaaatggcttccactctgctgcagccagtggacagcctcagcctggactggctcccatggagggatggggggccagtctcccaccagtgcactctaacacctacatccaagcatcacagccagccagctgggggccagtctcacgaaccagagcacccgcagcagttgcagcccagccacaagggattgactatttattagggcacctggttctggtaaccaggaaggactgaacttctgagccccacaggaaatcttctatataaggccacttcttcaagatcaagagacatagctgatttacctaatatatagaaacaaacacagagggcgcctgggtggctcagtggttgagcgtctgccttcagctcaggttgtgatcccggggtcctgggattgagtcccacatcaggctccccaggggagcctgcttctccctctgcctgtgtctctgcccctctctgtgtgtctctcatgaataaataaataaatagaatcttaaaaaaaaaaaaaaagaattcgtatccaagtgacggcaccaaaaaaaaaaaaaaagaaaagaaaaagaaagaaaaaagaaaagaaaagaaagaaaagaaaagaaaagaaaagaaaagaaaagaaaagaaaagaaaagaaaagaaaagaaaagaaaagaaaaagagggattcctgggtggctcagcagtttagtgtcgccttcagcccagggcatggtcctggagacccgggatggagtcccacgtcaggctccctgcgtggatggagcctgcttctccctctgcctgtgtctctgcctctctctgtgtgtgtgtctctcatgaataaataaataaaatattaaaaaaaaaaagaaatctgataggagttgtagggtggttggagaaggaattggctggaaaaagacaaaagaaaacattccagggggttgaaaatgtatctctcattttatgaagtatttcaacaggtgtgagcaattgtcagactcattgtactgaatatctaagatctgtacattttatgtatgtttattacatcttaattaaaagatctaaaagtcaatcacttttaatatcctagcaaaaaacaattggaaaataaaataaaacaattccatttaagatatcacaaagagactcaggaataaatttagcaaaagactttgccctaaaaattacaaaattgggggggcgcctgtgtggctcagtcagttaagcatctgactcttggtttcggttcaggtcatgttcccagggttgtgaaatcgagccccacactggggctctgcactcagtgtggagtctaagattctttcttcctctgcttcttcccctgttcatgctcactctctctcaaataaattaattaaatcttttttaaaaattataaaattttgttgagattgaagatctaaataaatgcagagatatgccatgtgaatggattaagaggcttgacaatgttaagaagtcacttctcagggagcctggatggcttaatcggttgagcatctgctttctgctggagtcatgatccctgggtcctggaatcaagccccaagccaggctgcccactcagcctgcccaagaagcaggctcctttggctcagggtgtgatcccgggagtcccaggactgaatccctctgcttctccctctgcctatgtctctgtctctctctctctgtgtctctcatgaataaataaataaaatctttaaaaaataaaataaaatgtcagtacaatcttgaaaaagaaaaatgatgggggacttatctaacaccctgaagccatagtaatcaagactatgattttgatgaagatagacatgaaattttatagaatagagtccagaaatcgactcacacttatacaatcaactgatttcaatgaaatgggaaatatttcaactaatagtcctagaataactggatatttgcatgaaaaataatgagccttgatacctacctgacactatccaccacaattaattcaagatggatcataaagggggcacctgagtggctcagttggttaagcatctgccttcagctcaggtcatgatctcagggtcctgggatcaagccacgtgttgggctccctgctccatggggagtctgcttctccctcttcctccccctctgtccctctctaacaaataaataaaatctttaaaaattaaaaaaaaggtggatcaaaaaaaggggtagatcataaagctaaatgtaaaagttaaaaccctaaaactttcagaagacatcatagggaatattttcagggcctgaggttaaatgaagatttctgagtaggacccagaaagcaataacaataaaaaaaaaatatgataaattagacttcatcaaaattttaatgttctgctaatcagaaaatggatagccatgggttgcctggctggctcaatcggtagagaatacaactcttgatttcagggttatgagtgcaagccccatgttgagggtacagtttatgaaagaaaaagaaagaaagaaaagaaagaaagaagaaagaaagaaagaaagaaagaaagaaagaaagaaagaaagaaagaaagaaagaaagaaagaaaagaaagaaaatagccaagccacagatatgagaaaatattcacattttattatcgatagtaatagggatccctgggtggcgcagcggtttggcgcctgcctttggcccagggcgcgatcctggagacccaggatcgaatcccacgtcgggctcccggtgcatggagcctgcttctccctctgcctatgtctctgcctctctctctctctatctctgtgtgactatcataaataaataaaaatttaaaaaacaaattaaaaagtaaaaaaaaaaaaaaaaaaaaagaatggccatggggatccctgggtggctcagtggtttagtgcctgcctttggcccagggcgtgatcccggagtcctgggatccagtcccacattgggctccctgcatggagcctgcttctccctctgcctgtgtctctgcctctctctctcatgaataaataaaatcttaaaaataaatttattagaatagctaaaattaaaaagattggcagtatcaaatgataaggatcttgaattaactggaattctcatacactgctgtcaagaacacaaaatagtacacatactttggaggaaagtatcttataaagctaaacatattatctacttaataacaaggcaattcccctcctgggagtatctatccggtgtgatagaataatagccccccgccacccccccaacaaaattgtccacatcctaatccccagaacctgtggatacactgccttatatgggaaaaggattttgcagaagtaaagtagagagagatgtcaagttgggaatataatcatgtattttctgggcccaatgcaggtccttatgaggggtccctaaagagggagacaggagattcagagagagagatgtggtggccaaagtagggagcagatagagagagatttaaagatgctacctaccctgctggcttcaagatggaggaagggccattgtttgcaggtggcttctagaggctggacaaggcaagaaaatagattctcttcaaagctgccagagaaatgcagccctgctgacccattttggacctctgaccaccaaaaccgtaaggtaattttgtgttgtttcagggcactgagtttgtgataattcatttagcatcaatgggaaactaatatacctagcaagaatgaaaacataggttcatgaaaagactttacaaaatgttccacagcagctttattcataataaccaaacaacacaggtgtccacaagaaagtgaaatgttctgtatctgacagggctgttaatgccctccaggcaaagaccaagaacacacttgtagttgaacaaagttgttgttgttttttttttttgctgattgaaatgagggaggatacctcccacggagaagcatagggtatctggggaagaagatcttaagaatgacttattacaggatttgggcctgtgttgggtgatttgggggaggttttcaggaagcagggctttgctctggattggatgctaataggaagcaggatgattctgtgattctgtgattgggtatcttcaaaaatcttacctaggggcagcccaggtggctcaggggtttagcaccgccttcagcccagggcctgatcctatagtcctgggatcaagtcccacatgtcgggctccctgcatggagcctgcttctccctctgcctgtgtctctgcctctctgcctctctctctctctctctctctctctgtatctcatgaataaataaataaaatcttaaaaaaaaaaatcttacttagaaagagtctggaatgaacatggcttaacttataactggtagagaagtagcagtctattcctatgaactgggagaggggatctttggtattttggtggttttcacaatgaacttgtttttatgttcttagataagattataaaatagtcttggggcacccgggtggctcagtcagttaagtgaccaactcttgattttggctcaggtcataatctcagggtcctgggatcgagccctgtgtgctcagcatggagactgcttgagggttctctctttccctctgacccctccgtatgtgtgctctctctctctcaaatcttaaaaaaatagggatccctgggttgcacagcggtttggcgcctgcctttggcccagggcgcgatcctggagacccgggatcgaatcccatgtcgggctcccggtgcatggagcctgcttctccctctgcctgtgtctctgcctcattctctctctctctgtgactatcacaaataaataaaaataaaaaaaaaaaatcttaaaaaaataagtcttgatttttttgtatacatcatcagagtcataaagtgaccttgtctggtgttattgtttgatggcattgtttatgtccaagaggaaaatggtgaggcctcactatgagtgccaggccaatttctttcttcttcttctttcttcttcttcttcttcttcctcttcctcttcctcttcctcttcctcttcttcttcttcctcttcctcttcctcttctccttctccttctccttcttctttctttttcttcttcttcttcttcttcttcttcttcttcttcttcttcttcttcttctttctttctttctttctttctttctttctttctttaagattttatttatttatacatgaaagacacagagagagagaagcagagacacaagcagagagagaagcaggctccatgcaggtagcctgatgcaggactcaatcccaggaccgcgggatcactccctgggacaaaggcaggcactcaaccgctgagccacccaggtatctcccaggccaatttcaaacacactaagacctacctgtaagggtgaggccagttcctggatgtcaggggctgcttttctctttcttaggggtgtgagttatatggttatacccatttatcaaaagaatggggaggtgtgggatgcctgggtggctcagcagttgagcatctcagggtataatcctggggtcctgggatcaagtcccatattgggctccctgcagggagcctgcttctccctctgcctatgtctccgtttctctctctgtgtctcatgaataaataaataaaatcctaaaaaaaaaaaaaaaaaaagagggcagcccgggtggctcagcagtttagcgctgcctgcaacctggggcgtgatcctgcagacccgggatcgagtcccacgtcgggctccctgcatggggactgcttctccctctgcctgtgtctctgtctctgtctctctctctctctctctctgtgtctctcatgaataaaaaaaaaaaaaaagaatggggaggtgcctgagtggctcattaaattgggaatctggctcttgattttagttccggtcatgatctcaggttgtgggattgagcccctatcaggctctgcacacagtggagtatctgcttgaaattctctctctccctctgcccctaccccaacttgcactctctctctcttaaaaaaaaaaaaaaaaaaaaaaaaaagatggagttaaaatttgtatgtttcaactttacccaaacatgcctgcataaaaaagaaaattaagatgactggggcagctggctggctcagtcagcagagcatgtgatttctgatctcagggtcatgagttcaagccccacatgagttcaagccccacattgggcatagagtttacttaaaaaaaaaaaaaaacaaaaacaaacaaccacaatgactaaaccaactgcaatatatccactcaatggaatactcaaaaataaaacaaactactgatacatgcaacattatggatgaatctcaaaacatgatgctgagcaaaggaagccagacagaaaactataaatagttccatttatttatctagtattctggaaaaggcaaaataatagagatcaaaacagtggttgccaaggtgtggaccacagtgaggcagcacaggggatctctttaaggtgatggcaagtcttccacactgtggcggtgtggtcaccgtgcagatctaaattcagtctattatttcctgcaggggttcatgtatttaccacgtcaccagcactcctggccacttctctctctctgctctccgcttctgccatcacatctctaactctcctgtctccctccttccttataaggacccttgcgattgcactccccccccacccccacaatacaggataacacaactgtgtaggatatacaactatgcctgtttatcaaaactcaaaactgtatccatataaaggatgaattttattgcatgtaaattatacctcaataggtctgactttatttttcatttaaaaaaaaaagatttttacttatttggtgggctgggggcaggcagagggagagagaatctcaagcagactctgtggtgagcacggagcctgacacagcgctccatctcatgaccctgagatcatggacctgagctgaaatcaagagtcagatgcttaaccgactgcgccacccaggcacctctcaataagcctgactttaaaaacataactgagggacgcctgggtggctcagcggtttagcgcctgccttcagcccagggtgggatcctggggtcctgggatcgagtcccgcatcgggctccctgcatggagcctgcttctccctctgcctgtgtctgtgcctctctctctgtgtctctcatgaatgaataaataaaatcttaaaaaaaaaataactgagttagggatgagtggggagtgggtgtatggttggatatgacgagaggcagaatgctggggactgctgaaacttggtggttggtgtatggtggtctgttctcttacgtttatatgtgtttgaaattttccataagttgttaatttggatagaaagggaaattgtgtgatggaggcagagatgtcacagagtcagttgactgctcattcccccaggatgctttttgcacattaatgaaccaatgcccctggagtctcaaattgacttcctccttttcatgcacttaaataagctagagctatttgctttgacattttttgctggtatgcctcaaaaatttttaatgccatttgattcttaggttctacaattatttttttcccctctaagttctccttattccctgcgcttgggtatcctctcccacttaatatttatttatttttaaagatgccctttccctcacaatggcctctttgataggtcagtaaaccatgcagggcttatttttcaagtggctgttcttttggatttgtgccatgcatttatcacgggcttccaataaagcacttttaaaaagaaataggctccaggctttctatgggctgtaactttttaaacaattcctttcatttctcccccttaatgccctcattctgtcctagtttccctttctaaaactgagcaattaaatgatggatttgccccctccctttcccgttagcaggctgaatgtgtattgtggtcactattgactgagtggtttacccatgaccactcagtgccccagtgtggtcactgtgcagacccagattcagcctactatttcctgctgcaggggttcaagtatttcccaagcagccagcactcctggtcgcatcaatcctcacctttatattgttaatcagcactcccgggataaaatccaaactcttcgcatctactactagaatggctacaataaaaagactgagcagacccagtactggtaaaaatgagaagcaactgaaaagtagtccactgctgatgggaaaggtgagatgatggtgcggccaccctggaaaaacggtttggcgagtcctcaaaatgttaatcgcagaattaccacatgacccagcgcctccattccttaaaaatgtgtggtatatccacacagcagaatacacgcagcaataaagaactcctgaggcaaggaataacaccaaggaatctcaaaacagtgatgtcaagtaagagaacccagactacaaaagaatggatttcttatgccatttttagaaaactctagaaaacgcaaacttttctgtatcacaaaaagcagatcactgtttgcctggagatgagcgtggaggaggatgagggattacaaactaacaggaggagacttttggggtgatggatatgtttagtgtcttgatttcataagcacatacatatgtaaaaattgatcagattgtatgtctaaatacatgcactttagtctaggtcaatgacacctcaataaagctgaaaaagaaaagaatggaaaataagacaattcctagacttggccaaggaagccccagccttctgagatactctctgatactctgatatggggactgcctgggccaggcacattattgcctcatgctgttttgagtttggactaaaacaagtccagacttgaaggtttagtgcagatggtcatggtgaaccactgatcacaaagattcagtagccttcccttggagagctgattgctccctcctccctgaagaaagccaccaagacaactacccataaccactaggtcacttaccatctagtatgtatttccaggtctgccttcccttatgctggcagagcttagtttcggtagtaaggatgtgtttcggttactttcataggcccaatgtaggtttgaagggattttttttttcttttaattttacaagtgttcttttccacagaaggggacagcatctcagagatgactccttaaggacatcattcacaaagctaacaattaaaaaggagccattgcatacaaggcactaaacgaggcccctagagcaaggctcagcatcagagaggaaatgagcaattgttcaagcattccagcacagcctgcgcaagccagagatgctgcaggctctaacaaggagagcctaacttgaagtaggagtgagttctgtcaggaacagcttcccagagatgatatttaatctgaagaatgaagaatgaagaagagccctgagtgggttggggtgggagagcttccaggtataaatggaccacagcatgcaaagagccaagggagtgagctgcgttagctggattctggaatttggagccttgttctggtaggcagatgagaagttgtgagggacctgtctggccacacaaggagttcggcattcgttcagattctagaagactctagaaggcaacatagaacttttgaaagattttaagctggggaatatcttggtcacatttgtgtttctaaaatatgacggggcaaagctggggacaggaaacctcttaggaaaggattgcagtggttctggggaagatatcagctgcctgaggcatgggcagggagggaagttcttgaaactggagatctgttacacttctgctctcaccttgggcccagccacccaccggccagtagaccatcagcttccttccacagcatcctaagaccaagtccttgtcctgaaagcttaaccaaaaaaggctctcaccagtcattgatacttcctctgagagccaagagtgcttcacactcattggaaatagataaaccttgtccccaagacagtgatcaaatcaggatctccctcacccgtgggctttgaaacgagtgtcctaattagtgctatcaataagactccttttccccatctttctccaaggtccaggaaggaaaaggataaatctattctaagggttcagcaatacagcagcagcaggagctcatgaccccaataatgctatggggctgctactggctgtattcccaaaccttggagaacagtttgagcatagtgggcattttagttctcaactggcctggcttctggaaacaagagatgggggattctagccagatgagcccatgctgccctgctggaggcccatgccaggcactgagtaagcagtgttccaggggaccctcatgttcagggctagaggatgcatccttctcaacattgtctcccagcacctaacataggcatatggtagcagcttcttaaagatctacagttgggacttttagggaatcagagatgaactgtcccagagttttcacccattgatggctgtgctcatgcaggcctctcactgccccttgtaaccagccacttcgggtaacattcctgggtgcttataatagtcaacatctacctttatcccccaaacccttaatttttctcattttgccccttctccctactcatgctctaaaataattaattttgggcagcctggctgactcagcagtttagcaccaccttcagcccagggcctgatcctggagaccaggatcaagtcccacatcaggctccctgcatggagcctccttctccctctgcctgtctctgcctctctcgctgtctctcatgaataaaatcttttaaaaataataatagttttatttgagagcgagggagcacaggcagggggagcaacagcagatggagagagaagcaggctcgccgctgagcagggagcacaatctggggctcaaacccaggactctaggatcatgatccaagctgaaggcagatgcttaactgagccacccaggcacccctctcaagtaactatcttaaaaaaaattcactttggacatatttatcacttatatagtatttggcatatgagttttaaaaagctctatacccaacatggggctttaactcatgacccaagatagtcacatgctctagactgaaccagcctgtgctcctggcaagcagaactttactgtgtagcattattttttttttccttagactgtgaagtcttttaaggcagatcttgaggcttcagtttcccagagcacatattagcactgatccctgaacaactaatccatggttattgattggcagtgggctttcaatctgcccaggtaggacaagggactggcgggcagaagagcagcctccattggcttgcatccacaggcgatgactctaccttgtatattccttgggttttcccagagtccatgggattttggagaatacctcctggaactaacttaaatcacgaaggaaagggctggcaaagagccttagccaaaaaagtgacttttacttttttgtaaaagacttactttttactgccggaaaaatcagcaaggctacagaggaaacccatctgcttgcttgctggcttcggtgggaaacagaaaggccaggagctactaacatttcacagtggaatccaggttaaacaatcacaaggcgtgtgaacacgggcaaaccacttgacatcacttgagccagcagaaaaattggataaaaagcaatctttgacaaggcagccaaggccgcactgaaacagcttccccaaacaccacctttctgccaaagcaagcttctacttactggtggctcagaatacaaagctcatctcccaaaacgaagtatgaagtgcacacttgggagttgctgtcggctgccaccttgtggtccaaattacaacgatcaaacccaggactctaggatcatggtggctaccagcacaaaaccacctgttgcgattctaatgttatgaacctcacttggctacttatctgcacaatgcttggactgaagtaacccataaataggactcccaagccctgcatccccttaatatccagttaccagttttgctgaccaaaaaaaaccttacttggcagaaatgtcccattactagttggcccagagccactgcctcatatgctgaccctgtcctgtgtatttactgtaaccatcaccatctgtggtttgatctgcaagccaaagccagcatctgacccaggaaacctgtgggatggtgtccctgaacttctaaggggctacacccatagggccacttccagacaccatgtcaggcttattgtggtgcagggccagcacggtcccagcaaagcccttgggggcacttggccccactggggaatgtcactgctcatccatttaatgtcacatgcagggctcccacttaaaaagcctccaggaacactggacaagtgcagtctgcctagtggaggatgccctgctctccccaatcaccccccagatggtaaccacactggatcagactcaacagggcagcatgtgctggaacagagggcccacgtctgagccaagtcctgcagctctcacagtggccaagtgatgccaccctggatgaaggcaactccttaaatggatccaatcttgccccatttacattctgatccttactcctgttcaggccacaaaatgcaaaccaaacaggacacacaagattaatgtttttctggctatagatttattcaacacaaaacaatctccaattttactgaggtggctgaccacgtccacgaccaaatccgcctctctgcaagaaaaaacatacatcagcattagcagcatgccagggagcaggcctcactctcacaggacatggccctgaatataggggctcatgagttcaggccataaatcccagtcctgcctcttactggctacgaggctacattcactttctaggcctgtttccacatttgtaaaatgggaatatagatacccactcaagagtgtttatatacacacgcacgcacccccagcacaggacgagtccccgtctgccacacacatcttttcacaaatgaggcctcagacaacactggtgtgctctgaaacctgccacaggacagctgttgctgcaacagtgatatgcctcaccctatataattaatatcacaagttctcaagagagctaccacgatcaggatgaggaaactgcagcacggaggggctgagccctgaagaagatgaaggacctggccccacaccatcctggacctagagctcactcaatttccagcttgtcgtgcataaccctaatttttataatttttagttcatgaaattaagagttacaattatgatgctcattaatgaagcagctaccactacgcagcgtattgatgtgggggactcattttagtaacttatgtatttataaaagtttgcatactgtatcttaatgtaaaagctcttgaaacatgggtttttttgggggaggggtgggatccagcacaccataccatacccctagaacttgcagaccccagggccgagaccagaacagtgaccacctatggagagcaaatagggatatactcacaaactggaactcagttgctgaccctgccccagcctcagctttcttgtcggcaccagctggaaagagaaataccaattcagtcatcatatgatatcatctattacagaccaagcgaagataagcctctggcctaattctgcagaaaaagccatgtcagcaaatacactgcatgaagtacaagtaacttacacccaggggtgggaaacaccccatgaaccacttctgccccccccacccccggcagcttcccttaagtcatccttcaaaacttacccgcaaaccttcacctccaggaaggctgcccagaccacaaagcctagattatatgcccttctatgtggcccaagaagaccctcacttccatcgagttacttacatgcttcagataagcatctagcaacaggggaagagataaaggacaaaaaggcccacagaagccaaaagcaaccctgtggtgaccacagcagagaacaagtaagatgaaagacccagtgctgccctgacctgtatggcaggcaagagtccaaactgaggtgtgtgaaaatacatctaacatttcaagacttcagaggatgggaagtatcttagtatttatagattacatactgaaataacattttagaactttgaggctcaggtccaatcttacattctctggagaaccactctctaactcccatgtgggacttctagtaagagccaccattaaccttctctcaagttagtctgatcgttggagaaatttgttctcactacccagtaacatagtcaagtgctcacttttattttataccttgctttcttaacacagttaactgcttctcaacaaagacacagactctaaaatcccaagtctgcccacggagctagggacctgtatctccatctgctctcctgctgtcttctggtttaacaagccaggtgccttaatgctctttccccagagagccactggctgactccttccttcaggtgtttaaatcacatttctgtggctttccctgaaaaccctactgaaaattgcaccatctgcacttgaatttttccctggagcacccacaccatggacatagtatatactcatttctgcttaccagtttcctaccactaaattacaatttcaacgagaaaggtcttttgtctgttatgcacactactgcctttccaacccctagaacacaacctggcaagtcagacactcagtatgtgttgactgaagaacaaacatctgttattccaagtcaatacaaacacgtgctacttaagaacaagatttctaactattttcgcattaagaaaacaaagatagggatgcctgggtggctccgcggtttggcacctgccttcagcccagggtgtgatcttggagttccgggatcgagtcccacatcgggtttcctgcgaggtgcctgcttctccctctgcctgcctctctctgtgtctcttgtgaataagggaaggaaaggaaagaaaaaaggaaaggaaaggaaaaaggaaaggaaaggaaaaaggaaaggaaaggaaaggaaaaaggaaaggaaaaaggaaaggaaaggaaaggaaaggaaaggaaaggaaaggaaaggaaaggaaaggaaaggaaaaaggaaaggaaaggaaacaacaaagataacgtaaacgggccctgccctcaacgagcttgggacacaggaatacaaccagaaaacaaagaaaagcatgttgttctcctgagttttcagtgctgctctagttaaaggtctttaactcaagcctttggtatccccagtgagggggcttgtctcttaatcccatccatcaaatacctgcaccaggtaagagacatagaggactccagctaaagatggcctggagactacgaatccttcctggtcaccttggcatttccaagggctaaaccccagccagggtgactgagaacccagagattctcccccaaagcccctgagagagatgctttactcacggggcacagcgcttcgtctgtaggtgtctctgtcagcttcccctcgtgtcagtcttgcaggtcgctctccctccagacctataaattaaaccacactgtgaatgtaaggcgatgagggaactctgttgccttcaggccaagaaaagtggaattgctctcctttttttttttggtttttttttttttttggaattgctctccttatgctcactggcagcaacttagttatgatgggttaaagggacacaactgagctgtctgccagaaatgtcaatcactgaccctagctcctcaaaggtcgaggacattaataatgaaaatgccatccatctgcaaaaggactgcctttttttctactgtttctcaacatacacaccctttccaattacttggcaaattaagcaatccaaccacttccacaaacatctaaatagcccaaattttgaacctgactcaactctgaagtggaaaatctcttgtgcaaacagcaaagccccaactccagtagtcagtgtataaatatagaggccaccaagaatcctccagttgccctgggcttctccacacacctcactagggtgtggatatatatgaaggcagacatataaactacttttaaaacattatcataaacactagaaatttaatctggtatttttcctagttaccctgcaaacttgccaactttactttcgagtccacatgattagaacataaactgtagtcgatcttgaacaagacaggtttgaaatgcatgggttcatgatctttttgatcaatgagattatagtagcacaatgaatctattttccttatgatcttcttaataatgttttctctattataaggatagggtatataacagatgtacaaactgtacgccaatccactatttgttatcagacagacttccggtcaatagcaagttgttagtagttttcagagaatcaagttatacatggattttggactatgaggcgggtagggttgggggagacggacgacgacacaggtgtcccaggccctgagctgtttcaaaggtcaattatgttattattttttcagcccaagaagactgaacctaaaataaatgccaggttccatctatgccaacaaaatcagaatctgtaggggcacagacaatggtatcccactgcccctgagactccaagatgcagcagagaacctctgctctacagatacataaccccaccacctaaccacctgaatcccctaaggagaattcataaaaaatacagattcctgagctaccaagcttctccctacgggacccagacagtcttggtgatcatctgtttttagggatctctgcacttcatcacccaagcccacagactactactaccaagctcctgtaacaagttctttcagaaactagggaaagagaaccataaccttgagaaaacacaattgtgagccagcaatggtcttgagccagaacgtaatccaccatccccccacaagcacatcctttcacactatcatacacacatccgttttcccctatttgacttctgattatttttgctcccatcgccaagaaattctagaaaattctccattccatttctctcacatgtggcaaacagttttgctccgtcctgccagttactcaatactctaccacatgtgcctggacacagactatattctgtgcttaatgggatctcctgggatggtttgaagaactgacctgactgcagttccattacaagtctaagtcccatgtcaggggacagaggctccaggacgaggcctaggtcctgcatgcagggctcctctaacgccgaccccaatggtgtatcctaaggcctcctttgccctccgcagtttcacgtacaccgttcctgagaaagagcagttgcagaccaggtcttttattcgggcgacatacctttgggccgtggcctgccggtctccggtctgctgcggcgcagagtggcaggcacgatctcggggggtaggtggaggtaatcacggagatactggataccctcgttggtaaggtaccagtagaaatgtctccaagcaaactgttcctttacgtagcctcgggatttgagagactgtaagacagaaagaaaaccaccgtcaagacacaagcagagacttcaatctagcaactcagtgcaaaaggaagctacgttgcatagacaagttttcacggtgtatctacctcagcgcccttggaggcaacaagctgcttggctgtcctgacctctccttggaatctgcctctagtttagtggaaaatccctccatctgcaccccactccagcagcccccaggctacctgcatggccttcatgacgtgaaggttgggcacattcttgtcggccagttcagggtgtttgggcatgtggacgtccttctttgccaccatcaccccctccttgaaaaggagttcataaatggcgattcggttcttcttgggcatcaacatctggaatgaagcaaaatcatccggagcgtttctaagcagtgcagctaggggccagccgggtgagctacgtgcaagaccccagcacgaccaccccgaaccccgtccaacgggctgaaacctcaaaccacagcacagaaaacatgcagggagatcttgaaaccctgcaaaacggaacgccgccagtgaccctcctccactccccagagacgcgtgagaagacagctgccgtgacactggagcagaaacaggggcagggctcccgaacgctccagacccacggaggagtaacgggccaggggggcgcgggcgcaaaccccgcaccccggggcacttggggaggatcagcaactgtacgcagcgcggaagggcgcggcacactttcggggacgcagggagggtctggagggccctccgttcgtggcgggccgcggacccaaaagcaaagggccgagcaaggaggcccgcaccttcacccccttccattcttccctcaaactagagctccagggccgggcaaggaggcggcccgcggcgagcgggcaaacgaggcgcagcttccctcacctcgcctgaggctggccgcgacacaagggcttcacacctcccctcctcggcctccgccgacgggacgccagtcctctcctactagagccccccggccccctcactactcaaaaacgggcgtgctaggagcgggagagcggccccccgccccgtccccggggaggagcagcgactgcgacagccggagagccaggatggacgccgatgcgagccggaccacggagaaactcaccttggcgcctgctacgacccggaccggggctggaaaggaaggggcatgcgcggcgcggcgcggcgtctcttccgggctggcgtgccccgcccccccgcgaggacccgcgggctgcctggggtggcctcggcggtgcctgacaggccgccgcggaccctgagcgctcccgcggcgcgcgtacgtggagcggacgctggcacctgtgagcctggtgccgggcggaaggcggttgccttggtgctgggactggcgcctcggaaacgcgctgctccttgacctcccacggatgacctgtgattatggaagtgatagatgttctttgaacggagacaggacagacaaaacgataacaataataaaagaatgaaaacagcatcctatgggccaaatgtaatggctcttaacattttggtatctgctcttccaaactcagatgcacccgcgcaaatacatacatgtacgtatttaacaaagacgggctgtttcgcgcgtacattatgtaaggtgtggttggtgaccttggcttttccgcttcccgacacctcatgaatgtcttttcgtgttaatgcctacggttgtaatgacaggagtccactggtggatagtttgatcaacactatgactggatacatattttaagacccttcactattataggtgacaatactacacacatatttgcacaactgccccaatatattttccttaggatgcatgcattcctgcaagttgtaattgttgagtaacaaagcacccatttttacgttttttacacactccgcattgacttccaagaaggcatcatccatttcattctagtcagcagttattaacaaggctcacttcccttttaaccctgctgggattggataatgttcttattcatatttgccagtctgataaataagaaatattaatttcgttgctcttttaacttacttgttttgattacatctgtggctcaacatttttctttttaggcatttgtattccttctttaataaatcgttcatttccacgatcagttttcctactgaaagttttttcctgctgatttgaaatcactctttacatatgaaagctattaatcctttgtcacatacttttccaaaaatttcccccattttttcatttgtcttgattttcatggtattttgaagtagaagtttcacattccttcatatccaaatctttatggctacagactttggtacaatgcttaaaaagtcacttaacccatctcaagattatgtaaatattaacctagtttcttcaaatatttttgtggtcttactatatagaaataaatatttgggggttcctgggtgcctcagatggttgggcgtctgccttcagggcaggtcagattcccagggtcatgggatccagttcatgtcaggctccctgctcagctgagagcctgcttctccctctgcctgctgctcctcctgcttatgggctctctctctgtcaagtaaataaataatatcttaaaagagaaaagagatggaatatctgaaagaaagggttagagatacgaatgatagacaaagtctcctgtatgtctaagtgaagtctcatagtgaaataatagagaatgtaagtaatatagaatataagagagaccctcagaatattttccagaattattagaaaacagcacatttcagattcactgagctcaccaaatccaagttggattacataaaaacatatccatccccacaaagaaaaaactgccaaataacataaaaataatatatatataactttatgcctaaacatcatgatgaaattgcagcatatcaaaaaacaaaagagaaaaacagcaataaaataaagagaagatctaaaaagcaaaagacaggtaggatttctttcttcctagcagcaataatggaatgccctcgattgaaattgaatctctcaagtctcttcccttataatagctagagtgatccctctacaatatcagaccatgtcattcccctgcttaaaacctccaatgactcccttgttcactttcaaaaatattgtcttttttgtgacttaattatgtttagatcttttatcttcctagagtgttttctgatgtaaaattttccccctctgaatgttaactgctatctcaacatcatttcctcaataagctaagcttctatttcttttttttttttttttaagattttttattttttcatgagagacacatagagaggaagagacacaggcagagggagaaacaggctccatgcagggagcccaatgcgcgactcgatcggggattcccaggatcacaccctgggccgaaggccgtgctaaaccgctgagccacccgggctgccctaagcttctatttctataaaataccagtaaattgtttatgatagatgaattcagttttagaatttgttgcattagtgcctatgagacacactggtgaaaataccagtattatttttttatttttaaagttaaatttttatttccagttagttaacctatagtattttttaaaaagattttatttatttattcatgagagacacagagagagagagaggtagagggagaagcaggctccctgcccggagcccgatgcgggactcgatcctgggactccagaatcactccctgggccgaaggcaggcactaaactgctgagccacccagggatccccaacctacagtattatattagtttcagatgtgcagtatagtgatccaaccccagtataattttagataaagagttcaggagttggggatccctgggtggcgcagcggtttggcgcctgcctttggcgcagggcgcgatcctggagacctgggatcgaatcccacgtcgggctcccggtgcatggagcctgcttctccctctgcctgtgtctctgcctctctctgtgtaactatcacaaataaataaaaattaaaaaaaaaaaaaaaaagagttcaggagttgtcctgtgggacagagctgggttagattaggtgagggaatcaactgaacgtgtaaggatatgagaacatctagagagggtgtggaacgagaagagggtgaggagggaccttagatggtattcctgtgggtgtctccttccctggatagggcctgctgatgggcagggaccatgcttttctctctgtgtcctctacagcagtgagcacaatgtctcacacgttaggtatacttaataaatgtttccagaataaacagcaacctcatggggagcagaagagattagaggttattgagtagggaaggaggacgaacagtaatactctctgacttcacagaagacttctctgatgacagtacatctttgggttcacttgaattccattcagcagttaggcacggagcacctggtgctgggccagatggtagggaagcattgggggcaggagcacacacgagtcccacaccaagcaacacaacctctattatgtgctgggagctatgaagaaaatgacagggtgtggtgacagaaggtaatggggagtgaggaggttgaaacctgtggagaagttgagcttgagttgagaacaggctggggacaggctcctcctatgaaaggctgtactgcagagaagtgcttggattgaaaggcagccagcgtggctaggacatggtgaacaaggcacaccccgacaggctaaagtggcctcagaaaggagtttgcagtttatttaaagtgtaatgaaaaagccacaggtttcaagaagttgtgacagggggcgcctggctggctcagtcagttgagcatggggctctcaatctcaaagttttaagttcaagctccacattgagggtagaggtgacttaaaaataaaaataaaatcttaaaaagtagtgacaggatcagatgtatgttttaaggagattaactttataaagatctataccgttttgattactcccatgcaatattgtgcataaggtataagcttgtctcttgccacatgttaaagatgcagaaaccctaaagaaccaaaaacctgaatctgaggcttagagaaatagatatttcttgctaggttacagaggtaagaggtgatagaactggagtctgactgctgccttaggctgcctctctgcaatggggactttttgctggggccaagggcagaggcagggagtggagaactcagtgcagtgagaggaaggactctggccttcctgggattggggctcacccctgtggcctgttagaatcccttggcaggttttaaaaaatccattcacccaggcttcaccctagaccaatttagtcagttgccctgggggtggaacccaggggtcagtattttatttttccatttttcttgatgtgtaatagatgtaaaatgcacagctctcaagcttccagctcaatgtatttcaatgtgtgtgtgaagataaatgtagataaatgtagataaatccacgtgaactaccatccagatcaacagatggaatgtgaccagaccccagaagtctccagtcaactcaccatgtccactcccagggccacctattctgacctgatagcacaacgatgtatctgcttgtgtctggctacccctcctctcgtgactcattaggtctgtgagaagccgtatcacaggcatcagcagtttgttcctttttgttactgagtgatgttccactgtatagttatatgacaatttgcctactcacttaccagttgatggacatctaagttgtttccagtgtttggccactgtaagtaaaactgccgagaatgttctggtggacatgggtgtggggcagcagcagtttctgaagcagccagccttgagaaccgccaactttgagaaatctctaaactcctgagtactcttgcagaagtcagggttggaaaaaaaaaaaaaaaaaaaaagaagtcagggttggggccctggggccccctgggagctgcacgttggaaataagtaaactatggcttgtaaagattttctagttgcagttcctttccttttgaggtgctggagtttttagcagaatctgtgtcgctgcaaggatggagggagattggggagcagtgccctctatggccagcatggtggcctctatttctgagtatcggggaacagagcagacatgccctttcatggcccaggtagggtgaggcactggctgtaacagcagagaatcacacctccccagcagacaccgtgggcctcaccatttccccacatctcccttcaccacgtctagaatagctttctaatcctgtagcctgttacttcctcccactcctgaagaaacctcctcaaaagagccatctgtgctgtgatttttcatttatagctcccacaacatatgtgagtttgtgatatgtaggtaaatggctgctgatacattcctggacacacacacacacatgcatgcatgcacacgcacattcgtgcacacacacacacgcacgcatgcatacatgcatgcatgcatgcatgcatgagtcacccacatttggtgccatggggctgacggtggaatttctcctctaagtggaacctgaccatctcctccacatgggcgaactgtattatggaaacctctccctcagtgactatcaccttattgcctgtcattgtttggagcagctcctcggacctcacctgcctggagcggccatgattatttctccaaattatttgtttcatttaaaaaaattcttttttagttttagtttttttttttttaagattttatttatttattcatgagagacacagagagagagagagagagagagagagagacaggcagcgggagaagcaggctccatgcagggagcccaatgcaggacttgatcctgggactccagcatcatgccctgggctgaaggcacccaaccattgagccacccaggcaaccctaaaaattttttaaaaaagattttacttacttgacagagagaaaggggcacagggaaagggagaagcaggctccccactgagcagggagcccgatgtggggcttgatctcaggaatcattacctgagctgaaggcagaagcttaactgactgagccacctaggcgcccctccccaatttatttgataatgatcagtgttgaggcgaaaacagtagacagagttcaaggactgccacacttttcaggctgttggatctgttgtcttgcattcctgctcttgttgctgctgcagagatgatcttaccttgctgtcaaggtctgattcatcccccgtcacccataaacctctgagcacttttcatacttccttttctttttagctgactaattacatctttgggtacctgtttacaggtggacaacctgacgcttgcgagggcagggatttctgccagcagtaagtgaagctggtgagcgggtatcccagcagccggggacagtgcctggcacacatgaggggctcgataaagatttcttaataaatgaagctggtgatgcatcttggttttgaaactcccagctcaatatcctctccctaatgagcttccttcctcagcacagaccaccaggacaagcaagatagccatgcccctatctggagagttcctctctggcccccattggagcctctctctacctctgcaattgagagcacagactcctactcagcctgttgcaaatcccagtgctcccattatcactgtggcgccttgggcctatctcttagcttctctatgcctcagtttccttatctgtcttctggaaataataatagtaccaaccttgtgaaattgtgggaaggattctaagagttcatacaagtgatgcatttggagcaatgccttgcacatgagaagcactcaagaaatgttagtgtcattttaaattttttcaatttatattttactatttcattgtaaaataaaatcaaacaggggcatctgggtggctcagttggttaagcatctgccttcagcttcggttgtgacctcagggtcctgggatggagctctgagtggggctctctgctcagcaggggtctgcttctccctctccctctccccctccccctgcttgtgcaaattctctctcaaagaaataaaatcttttaaaaaaaatcgtattttgggatgcctggatggctcagcagttgagtgttggccttcagctcagggcgtgatcccagagttccaggatcgagtcccacatcgggctccctgcatggaacctgcttctccctctgcctgtgtctctgtctctctctctcgtaaataaataaataaaatcttttaaaaaacaaattaaaaaatcatattttatttttattaactgtacttatttattatttaatatttatcattattttaattatttattattacagaaaataaaagtatagcttcgtgaatttttataaggcaaatgcacttgtaaccaccatccatgtcaagaactagaactttgttgtaaccagcagcccctcctcaccaccccatcccaggtacagctcctggctttctcccacagtgaccaccagcctggctcatagtattcacttccatggagttttatcacctacgtgtgcatctctagacactgtagttcagtctcgcccaggttaaaaattaactttatggggtataatttatatgcaagaatgttcaccaattttaagtgtgcagtttgatgagttttgacgaatatatacagtcatgtaaccaccaatcatgatataagaacatttgtatcacctaaaaaaattcccttgtgctcctttacactccaccctcctcccttactcctgagtccaggcaactactgctctgctttgtttttgttttaagattttatttatttattcattcatgagaaacacacagagagaggcagagacataggcagagggaaaagcagactccatgcagggagcccgatgtgggactcgatcccaggactccaggattcaggcccttgggccaaaggcaggtgcttaagcgctgagccacccaggcatccctactgctctggtttgtcactacagattaaatttcccttttctaaacttctgtgtaaatgaaatcatatggtatattcttttttaatgaatagcttctttcattcagcataatggttttaaaatttattcacactctagcctgtttcagtattttattcctattgctgctatgtagtattccattgaacaaatatattggatgtttatacactctgcttctgtgggttttttttttaaaagattttatttatttattcatgacagacgcagagatagagacagagacacaggcagagggagaagcaggctccacacagggaccccgaggtgggactcgatccagggtctctaggatcacaccccagggctgaaggccgcgctaaaccattgggccaccggggctgcccctacactccgcttttgatggacatctgggttgttagcagtttttggctatcatgaataaagctgctgtgaacattagtttacaggtttttgtatggatgtatgcctttgttctcttgggtaaacacccaggagtgggattggtaggttacataaataaaagagctgtgttaaattttatatgaagggcgcctctgtggctcagttgctcaagcagctgccttcagctcaggtcatgatcccggggtcctgggagcccagtgttgtgggctctctgctcagtggggagcctgcttctccctctccctctgctctctctcccctgccccccaccctcaccgctggtacactctgtttctcttttcaaatcaatcaatcaattaattaattaataaaatctttaaaaatataaaatcatttggtttttttaaccccttctttttgcagtaaagtatgcatcccataaaacttactattttaggggcagccccggtggctcaccggtttagcgccgccttcagcccaggacgtgatcctggatacctagcatcgagtcccatgtcgggctccctgcgtggagcctttctccctctgcctgtgtgtctgcccctctctctgtgtgtctctctcgaataaataaataaaatttatacaaaaaaaaaaacttactattttaactactttttaagtatatgggcagtcttttacctatttctaaacctggatcacttttcctcttattgaattgtaggagttatttatataatctggatggcagtacttttttcagatatatgtattatgaatattttctgctactctgtggcatgtcttttcattttcttaacaatgtgttttgaggagcagcccctgtggcacagcggtttagcgccacctgcagcccggggtgtgatcctggatcgagtcccacgtcgggctcccctgcatggagcctgcttctttctctctgtgtctctgcctctctttcgctctctctgaataaataaataaatcttaaaaaaaaaacaaaaacaatgtcttttgaagaccagaagttttaaattaattaatcaattattaatagtctgatttattaattttttaaaaagatattatttattcatgaaagacacagtgagaggcagagatgtaggcagagggagaaacaggcccctcgcagggagcctgttgtgggacttgatcgccagatctgggatcacatcctgagccaaaggcagactctcaaccactgagccacccaggcgtccctaatttattaattttttaacaactatgctttttgtttcccatctaagaaatctttgtccacctgaagggcacaaggatagccttctatgttttcctttagaagttttgtcgtgggggcacctgggtgactcagttggttagcatctgctttcagctcaggtcatgatctcagggtcctgggatggagcctgagtcaggcttcctgctcatctgggagtctgtttctccctctccgtctgatcctctccttgctcttgctttctctctttcaaaaaaaaaaaaagaaaagaaaagaacaagaaagaagaaagaaagaaagaaagaaagaaagaaagaaagaaagaaagaaagaaagagaagaaagaaagaaagaaagaaagaaagaaagaaagaaagaaagaaagaaagaaagaaagaaagaaagaaagagaaaaaggggcagcccgggtggctcagcggtttagcgccgccttcagcccagggcgtgatcctggagacccagaattgagtcccacagggggctccctgcgtggagcctgcttctccctctgcctgtgtctctgcctctctctctctctctgtgtctctcatgaataaataaataaaatcttagtcttatacatcgttttaactttaatgcttatatctatgatccatttcaaattgaattttgtgtgtggtataaggattgagattctttttgtttccaatggacatctagttcttccagtgtatttgttaaaaacactattctttctatattgaacaattttggcacctttgtcgaaaatcaatagaccataaatttgtggatctgcttctggactcttttcttttccactgttctgtggttcttcctgacaccagcaccatacttccccgatgctgttgctttacagaaagtcttgatatcagatactgcaagatttctaactttgttcttttttctttttaatttgttttggtttgctcattaaaaaaagtttttttgataagcatcataaagaaaaggaaaaatgtaaagattgaatgagaataggagaaataacaactaaatgcggtgtgggatcctggatcagactctggaaacaaaaagggatattagtacaaaattcatgaaattaaagtcggatctgtggtttaatttgtgttgtacctgtgttaccttcctatccttggtgagaaggtatgaacaccaagagaaaaaagtggaggctgtaggacaactcttggtactattcttacaacttttctccaggtctcaaattagctcagaataaaaggatttttagggacccctgggtggctcagtggttgagcatctgcctttggcttagggcctgatactggggtcccaggatcgagtcccacattgggcttcctgcaaggagcctgcttctcctcctgcctatgtctctgcctctctctgtgtctcatgaataaatagataaaatctttttttgaaaaagattttttaaatgtacggacactgattgtaacagctgtaccaatctggtgggggaggggcaggggctacatgaggactatactttctgtgcgattttgctgtaaatctaaaacggctctggggcgccggactggctcagtcaaaggaacgtgtgactcctgattttgggattgtgagttcgagccccacgttgggtgtagagattatttaaaaataacatcttaaaaaaaaactgctctaaaaaataaggtctattaaaaaagaaaaaaagaggagtgcccgggtggctcagatggttaagcatctgccttcagttcatgagggtcatgatcctggagtcccacattgggctcccagctcagtggggagcctgcttcttcctctgcctctgtctctctccctgctcatgctctctctgtatctctttgtctcaaatgaataaatacaatctttgaaaaaagagaaaaaggtgcaaataaaaaaggatgagatagaaaaaaaaccggatatgacttttgggggtagatgtttttctcccaacttttttgttgtggtataatacatataacataaaatttactatcctcaccattttgaagtgtacagttcaatggcattaagtacattcacattgttgtgcaaccatctccaccatccgtctccagaactcttctcatcttgcaaaactgaaactctatacccgttaaacaataatttcccattgccccctccatcaagcctctggcaacaaccattcattttctgtctctatgttttgactactctaagtatctaaaataagtggaatcaccgtatttgtcttcctgtgactggtttatttcacttagcataatgtcctcaatatttatctgtgttgtagcacacacacacaacagacacaaataaaaagaatgagaaagaaaaaaattgatgtcttttaactctcttttattttattttatctttagagctttatttatttctttgaaatagagcacttgagagagagcatggggggagaggacagagggagaaagagaagcaggcttcctgctgagcagggacccccccaactcaggccccaatcccaggaccctgggatcatgacctgagccaaaggcagttgcttaagcaactgaaccacccaggagcccctaaactgtcttttaatctataggttttcccagtgtattcatttttctatgctgtataatgcatcatcacaaatttagtgggttaaaacagtgcacattttaaaaaaattattattatcttagactgtgttttgggggcacctaggtggctcagttggttaagtgtctgactctcaatttcaactcaggtcatgatctcaggattgtgggattgagtcccatatcaggttccacagtctgcagggagactgcttgagatcttctttccgtttgccccttcttttctttttttttaaagattttatttatttattcatgagaggcacagagagagaggcagagacacaggcagagggagaagtaggcttcgtgcagggagcccgatgtgggactcaattctgggtccccaggatcacaccctgggctgaaggcaggcattcgacctgagccacccaagcatccttccctttgcccctcctactcactcatgcacgccctctctcaaataaataagtaaatcataaaaaagatgtttttaattgatgtataattaatatacagtgttgaattactttcaggtgtacaatacaacgattcaacaattctgcgcatttttcagtgctcatcaggacaagcatactgttttttatcacaagtgcactccgtaggccccatcccctatttccctcattcccccactgactctaataacatcagtttgcgtcttggtttgtctctctgttttttcttcctttgctcaattgttttatttcttaaattccatgtagaagtgatatcatatggtatttggctttctctgatggacttatttcacttagcgttatactctttaggtctatccatgttgttgctaatggcaagatttcattattttggtggctgcataatattccatcatatatagataccaagtctttatctattcattatggaaggatacttgggttgcctccatatcttggctattgtaaataatcctgcaataaacataggggtgcgggatccctgggtggcgcagcggtttggcgcctgcctttggcccagggcgtgatcctggagacccgggatcgaatcccacgtcgggctcccggtgcatggagcctgcttctccctctgcctgtgtctctgcctctctctctctctgtgtgactatcataaataaataaagatttaaaaaaaaaaataaaaataaacataggggtgcataaatcttttcaaattactgtttttgttttctttgtgtaaataccagtagtctgattactgcatcatatgatatttctatttctcatttttaaaaatattttctttatttattcatgagagattcacagagaggcacagacacaggcagagggagaagcaggctccacgcagggagcccgatgtgggacttgatcctgggtctccaggatcacaccctgggccgaaggtaagcgccaaactgctgagccacccgggctgcccctatttctcattttttgaggaacctccatattgtcttccacagtggctgcaccaatttgcattcccaccaacagtgcaagagggtttctttttctccacatgcttgccaacacttgttatttcttgtgtttttgattttagccattctgacaggtgtgaaatctcattgtgtttttctttctttcttttaaaaattatatttatttatttgagaaagagagtgagagcgagtgagagagagaaagagagcgggagaaagcacatgcgcacaagtggggtaaggggcagagggagaatcaggctccccgctgaacagggagcccaatgtgggtctcgatctcaggaccccaggatcatgcttgagccacccaggcggcctcccattgtgattttaatttgaacacacatttattatcttacagctttcgtgggtcaaaggtctgggcatgactgcattgggtcctctgctcagggtctcataggctgcaattaatgtgttggccaggctgcattcttgtctggttgtccaattagggaagaatccatgtttaagctcattcaggttgttgacagaactcatttccttccggttgcataactgagagccccagctgtttgctgcctgttgagtgaggctgcctttaggttctaagagctgccccaaatttcttggcatgtgaccctctcgataggctgttcatagcatggctgttttcttattccaaatgaataagagaatttctacttcttgtgtagatggagtcttacataacaaaacagccatggtagtgacagcccatcatctttgccatattctcttggcttggggcaagtcacaggtcacacttgcactcacaaggaagggattgttcaaggtcatgacttgtaggggagtcacttaggatatgtgcatcacactctccacccacttttttcttttctttttttaaagattttatttattgattcatgagagacagagagagaggcagagacatagaggaagaaccaggctcctcagagggagcccaatgtgggactcgatccctggacctgggatcacaccctgagctgaaggcagacactcaacccctgagccacccaggcatccctgcacccacttttttcttgagttaatttgttaaggtactgggctgttactgtagagtttcctagtctagattttccttcttttcacaaaattatttatttatgtatttatgtatttatttatgtatttatttatgtatttatttatgtatttatttatgtatttatttatttatttatttatttatttatttatttgaaacagagtgtgcatgagtagggggaggagcagagggagagaatttcaaacagactctgctgagcatgaagcctgatggcagggctcgatctgagatcatgaactgagccaaaaccaagagtcagaccttcaaccgactgagccacccaggctcacttcagtctagatattctgatttcacacacagtgcagttcaacatattcttctgtctcctgtatttctggcaaactggtaactggactcagaggattgaccagactcaggttagatccctttggcaacatttaggtggcaatgtgatattccctcaggaggcacatgatgtctggctgtctctctttgtgatgttagcagtcattgacaatgcctacatcagttaattcacagggtgtggtgaaaagatgatgttctatttttactattgaacttattggttgcaacacttttataaagagattctttccttcatctattacttggttatccagtggcatagttcatatagggaaggcagtataaatggttgagtcatttcttttatttaccaatttccaagacaataaattgattccctatccaggtggccaattatttttttttgggggggggcactccatttttattcccagagctgttgccactcagttattttgtgtcccaaccctgtaaatggcaaaaacccaacccctctttggcgtaaactttcaagagaaatggaacagcatagttttggagtttcccaaactggctggagatctgcaaggtcaggtcgttccaagatttggggcatggccaattatttgtgagcccgtagatttcagcatatttgattgatttgaatccattgcatttcttatccttattgaagctctcaggatccagtgggagcctcttcaaactggctcctgagtctttttgacatgatcctgttagtcttcgagagcttcctgctagctgctgcatcaaggcttgttgtgtaccttgcatctagtactttcctgctccagactcgaaaccaggcatttctccaagaagcttgatttatgttcttgggaaatgatatttcaggaccacaatctgggctttcaggaagttcattgctgttgagttggtcactgcttctggtctttttggtggatggactagaaaaatctatataatcccttgggatctcatctgatatggagaagaagcatggtattgttgctgggaggcaaataaattaataataggcacactcattctttttcctggcccttctctttccttcatttctatgtccctgtcccatggctcaatttaatttcatgaccagcagtgtctcgctagtgtgggggtcccgtcccgtgggcagggagccttggctaatctctccaagactttatgggagttgcacctcccagccccttcaagcacctcgcatctggtcacactctaatgtcagctgctcttctcaaattggatgctgtgctttccatgaatatctgttgcttattttggggttctcctgttttcaggtcaccagatgctaccccgattgcttcactctgcttcttcccccacagatgcgagtcttgcagccgtctgcaatttgtcctcatccacttgcattttaggctccgtggagacagcttgtcaccacttgtgttgtaaaccttgtctgtggcttttggtgacagcttagggtcactcactcagctggtggctgggttaggttggaaggtccaaaaaaccctcaatcggcataagcaaaaagctgctaggtctcctcaaggtcacccccactgcattctgtgggtcacaagtcccgctcagatgcaaggagagagaaacagacgccaccttctgaaaggaggagcagcagtttcaccctgaaggggatggactggaccatctttggagatcccaattctagcttgtctgaccctgagcccaagcaagcaccatccccaaccctggggcccacagaagcctgtgccagtcactgtcactaaggggtaaggcaagaagggaagggttgggggaagggggctcctggcctccagttccagaagggaatcttggtgtcccacccaactccaccatactccacctagtttggagtttctacccggggctctggggaggcaccaggatgggtgagccctctgtctccagggaccagcactgtgagaagggaagaaattagctctcatctctcctccccgcccctggcactcataggccctctgagggctggcaggacatatggccctgccggtagtaagttaagctgggagccctgccaggaagggccagatggaacgggaagaaggcaccgaccagccagcatggccagcaccataaataacagtcctgggtgtcgtggctgctctgcaggcccattgcgcggttctgcagtatcctggaagcacctctggcctcagactgcatgtggagcagcttggcacaatagctccttgcagcctgcagggcgaggacagctgaaggggagggcggataatgtgacaagtcagggccaccccccaaagtcatcattttgttcctgccttgctgctcctctgtgcgtgggactgagcctcccggctgaacgtgaagacaagtcaccgccaggagccctggcattctgagggaggagagggcagggcattttactctctgatgcttcaacttttgttctggggctggctgggagtgccagcaaggctgatgccatatggcagttccacttcctcagcaatacgagtaggtttttgcaaattggagagcaggccccgagccatgttccagctgcttcctgtgcctggctcttccctttcaggggaagatttgactttctgcctcacatcagattctacagactgaccctttcctccttaagaatcggagacagggagtcctacccaccagaacgccccacttatcttcgctgtggggctaacggtgagctctggtgtcaggcggaccagagggggccaaaatgagccaggctgagtgtggagccccctgctactgtcatgtcttggtgtaggttgcaccccccgtcccccgccccgtatttggtgtcatcaggaaacatctcagtgctctgattctcaaagtgtagccctggttccacgtgggagtctcttgaggagctttagaaaatgtcaggatccaaatcaaaggagaatgaaataatgcttcacagacattagaatggctactatcaaaagccccagagaacaacatatcttggcaaggacatgggtaaattggaaccctgtgcactgttggcagaaatggaaaatggtgctatggagtttttttaaaaaattcaaagaagaattgctaaactaagcaggttcagcaatcccgcttctgggtatataaccaaaagaactgaaagccaagtctccaagagacatttgcgcatgctgtgttcattgtaggcattgttcacagtggccaaggggcagaagtgactcaaatgtccatggctcgatgaagaggtggagaagatgtggcatatgcacacacaagggatagtacatggcctgaaagaagaaggcaatcctgtcccacactacaacatggatgaaactcaaggacattatgccaagctaaataaaacagtcaaaagaggacaaatatgttatgattgtactggtctgaagtacctgaagtagtcaaaattatagaaacaaggacgcctgggtggctcagaggttgagcgtctgcccttgactagggtcctgattctggggtcctgggattgaatcccgaatagggttccctgagcggagcctgtttctccctctgcctgtgtctctgcctctccctgtgtctctcatgaataaataaataaaatctttaaaaaatattatacaggaaatagatggttgccaagggttgtgggaagggaaagggaaaattagtgtttaatagatatagagttttacaaggtgaaaaagttatagacatctatggacaataacttaaatatacttggggcacctgagtggcttagttggttaagcatctaactcttgattttggctcaggtcatgatctctgggttatgagatcgagacccaggtcagactccatgctgggtggagagtctgcttgagattctctccctcttcctctgcactgtaaccccccatactctctctctgcctctctctaaagataaatcagtaaatcttaaaaaaaaaaatatatatatatacttaacactagtgaactgtgcacttaaaagtagttaagatggaattttcttctaagattttgtttttaagcaatctctgcacccaatgtgggcttgaacttaccaccctgagatcagtagttgcatacttcactgattgagccagtcaggtgccccaattaaggtagaaaatgtaacattttgtgttttttttttttttaagttttattcatttatttgagagagagaaaaaactcttgggaaccaaggttgtgggggtgggtagagggagaaggagagaaagtatcccaagtagacttccatgaagcatggaatccatgtcaggtcttgttcccatgacctgagccaaaatcaagagttggacactcaaccaactgatccagtcaggcactcctgcatgttttctttttaaacaacaatttttaaaaaatggactcattttcatttgcaaatgcaaacaattttttaaaatgcaggttcctgggctttgccagacctctggaatcagaatccttacagaagaggctcagaaagctgcctttcagggatccctgggtggctcagcggttgagtgcctgccttcggcccagggcgtgattctggaatcctgggatcgagtcccacattaggctccctgcatggagcctgcttctccctctgcctgtgcctgtgcctctctctctctctctctgtctctctgtctctcatgaataaataaattaaaaaaaaagaaagttgcctttctttttgccccctttttttgtgggaagctgctttttaagcagccctcaagtaattctttttttttttttaaagatcttattttatttatctagagagagagagtgtgtgcaagtgcccacacacacacatatgcacacatgcaaaagcagaggaaaggtagagggtgagagaatttcaagcagattttgctttgagagtacagccaaatgtggggcttgacctcacagtcctgagatcatgacctgagcccaaaccaagagtcagacgcttaactgactgagccaaccaggcaccccagtcctcaggtaatttttaaacccagtaccttttcttgtcttagataacatgattaggaaaacaggtgctgaaactaaactgcctggcaactaaagtgaccctagaaaaaaaatttgtgttctcagtgcattagttttctcatctgtatgatgggaatgatgacacctactcacagataggagtgctgtaagaattaaattagttaaccgtcacaaagcatttgacatggacatatgactgccaagcacctccttttgtccaagtggatgtgaggcctagagaaggaagaggccttgtctgagcttagtcctcaacgtagggccacctctcaggtcaccgaacacgttcacctgccagatgggctgtcctgtatctcagtccctgagggcttggccaggagactggattgatcactacactcagactagagaggaactcagccctttctcgaacaccactgtgtttccccagaatgcctccaaggtgagcccacattgttccatttccctggcagatagagtgagagcttgttttagacaagcatggacacatggttggggtgctgtgggtgggctggcatgaagcagtgggcccctattatcaatgcctgggctttctgtgtctgactccctggcttcaggggatgggacagcacagcatcttgggagggttcctggtcttatgtgaccacaccagcaaatgcaacctaatggccgcttggtagaacactaagaacagtgagggtccctaaggggctcagttggttaaatgtctgcctttggctcaggtattgatatctggatcctggggtctagtcccgcgcattgggctccctgctcagcagggagtctgcttctccctctccaccctgctcatgctctcactccatctctcaaataaataaataaaaccctttttaaaaagaacactaaaaacgatgacagagaaaatgggttgcctgtttactgtgtgcctagctctgttatgattatgatcccagtttatagatgatgaaacagacatacaagcgtttacctaactcatcccgagacacacagttaaagtggaagtagcctgggtggttacagagccctgggtctgggtcccacttcgctccatgaagagggccagtggggtctgttgaagtagaccatgtccaagtcccagctatgtttctcattggctgcatggccttaggaacgtcctagtttctctgagactcagtttctccatctgtcagatggcaataacgatctttatcctgtaaggctgatataagagtgagggccaagtggagcgtgttcatttcttatggctgccattaacacaaatttagtggcttagaaatccaaaatgaaccttatggagctaaagacatgactgcactgctgatttcttctggaggctccaggagagaatctattcttttttttttttttttttcaagattttacttatttatttgagagagagtgcatgcatgagtggggggaggggtagtgggagagggagaagcagactagactccccactgagcagggagcccaatgaggggctccatcccaggatcccagggtcatgacctgagcagaaggcagatacctaactgactgatccacccaggtgccccagaaagaatctattttttatctcttgtagctcctagaggctgcctgtgttccttggccacaggccacctcaccccagcctctacttctgtcatcccactgccttcctctcttctgtagtcagaagtctctccctcttagaaagacccttgtgattacattgtgtccacccaaataatctagaataatctttccatctcaacagccttaatttagtaacttctggaaagttccttttgccacaaaaggtaacatattcacaggttctgaggatttagatgtagacttctttgggagaagtggccacctttctgcctactccacagagatcagcagaaaggaggggtgaggtgggtgatcattattatcttctgatctcaggtcgttaccaactagctgtgtgatcctggacaaggtgttctactgtctcagtcccagtgtcctcatgtgtgaaatgggcataatgacagagactataaaacaagggggctgcattcagtgaagatgccaggcagtgtctgttgcatgagtttgctgaaggatgtgcatacactgaggtccctccagggagcctggtgcagggtgaggaatgaggaggcccaactccagaatgaaggaagtggaaaggcgcagaggcatgcttggtctctggggtctggtgggtgtggggctcagtccatggccctgtgttgtctctggggccgggtgccagctaggctctgtggcagggcttgggaggcttggggcgttgggctgtattataatttgagtaaaggttgcagctttgggggatgggacagagattctgctcatggatgagcatctcgcagtcaccatgcctctcttcttccttcttccttcatggagttcatggcgtgtgggcaggggcagggtgtgctcacaagcagacctggtcctcagctcctgccttggcctgctccactgccggcagagcgaaggggacagagtggggtggtggggatagaagggggctcagagctgatgtggcctgcccagctttctcctgtcagggcaaatgcagattcagttctctgggacggggacccagagccaaagaggagcaggagaagaatgaagggtctcctttctggaaaaagtgccaaactctttttctcagtcaagatccagattttccaggagaaaaaaatccttcccttcaagaagtggacacgctatgccattagtggagtagtctccccaatcccttcatggagcaccaccacgtcctcacattattggtagtctctctgacaacaattccaaagtgaccactgtttgctccatgttgtagatgggaaaggtgagcccaagggttcagcctgggcccagcctcactcttacatagccagcaagtggcagagcctgggtcggggctcaagaatgcctgggcccaaggctctgcaggctttccctgggcaggccaggtagcctcagaagtaagaaaaggggttttgtaatgaacagattcagggcaattcctatgaggagcccaatagccttttttttttttttttacagaaatagaaaaactcatcatcaaattcaaatgaccctaaatagatagggtcacttgttagataaagcactctttaaaaaagaacaaagttgggagtgctgggctggctcagttagtacagcatgtgattcttggtcttggggttataagttcaagccccatgttgggtgtagagattaattaaaaataaaatcttaaaaaaaattaaaaagaacacagttggagatttcacattttctgattttaaaacatactgcagggacgcctgggtggctcagtggtagagcatctgcctttggcccagggcgtgatcctggggtcttgagatcaagtcccacatcgggctccctgcatggagcctgctctctctgcctgtgtctctacctctctctccctgtgtctctcatgaataaataaataaaatcttaaaaaaaaaaacaaaaaaacacttactgcaaagtgaggcacctagatggctcagtctgcctttggcttgggttatgatcccagggtcctgggattgagccccacatcaggctccctgctcagcggggagcctgcttctctctctccctctgatgctccccctgctttctttctctctctctctctctctaataaataaataaaatcttaaaaaaataaagcatactgcaaagaaatagtaatcaagatggtgtggtaatggcaaaaagacagatcaatacaacagaatagagagcctagaaataaatccttatgtgtatggccaaaagagttttgacaagggtactaagactactcaatggaaaaaggacactctcttcaataaatggtgttgggaaaactggacagccacatgcaaacatatgaagctggatccctacctcacaccatgtacacaaattagctcaaaatggatcaaagatctaaacataagaactaaaactagaaaacttttagaagaaaatattggggaaacttcacaacattggatttggcaagatctcttggacataagaccaagaacacagacaacaaaagaaaaaatggacaaattggacttcataaaaattaaagattgtgtgcatcaaaggactttatcaagagaccagtgaaaagtctgattctgttttttaaattttgttactgatatgtaattcacatgatataatgaatgatatgaaataatttacagaacataaaattcactattttaaagcacacaattcagtagcattttgtatattcagaatgttgtgcaaccatcacactatctagttccagaacatctccaacaccccaaaaagaagtccagcactcattagctgtcactctccattcatccctctcctcatcctatggcaaccactaatctaatttttgtctgcatgaattcgcttatggactccattgtttaatataacatttaaatcatatttttcccattatcaattttcactgagaaaatgttttctggagtgaatgatatgaagataattccttgaccaattttctaaaatatatggtaaaattttgcccattttaatttttaccttattgagatttttgtcactgggatcaattcttcactaataatttttaaaaatcccatgtgatttattgacttttgtggagggaaagtacatatcaagttttactgtctagagctcctaagattgtgagttttctttgtgctcatatttctatcaagtattatttccctgatcagattttacagatatgagttttgtcaagaagttctgcttctttctttgggtcatttttatgttattttgatgacttcttgggaatgttcattgacctccctcgtaaagactatccctatcccctgttactctcttgagtctcgttattcttcgtagcattatcaccacctgacatgattgtatacttatttatctgcttattatctctctccccacagggctgcaagcctcatgagggcaaggattttgcccgacttgttcacggctatattcccagcacacagaacagtgcctgggacacagagggccctcaatacttggaatgaatgaagtaatgaagtatggcttggatagaacactgccagtctgtatttgtctcataacccatgagtaaaaccatggggaacctttggagacaaagaggcagagggtaagagagaaacagtgcaggactgagaagggtcccaggccccagtgatgcggccaagccatcctactctactgaggatgagctaagttccaaggagcttccaattttgctagggagacagataaccaacaaagcagtctctgctccactgtttgatttactgttactccaagtggtgacttatggcttaggggcagcaaggcatgtgtcagcacaactggaaatggtgctttccccctcttttgccctgatgctagccagaccatcagggcaaaaggagagacaaggaggtggagctttgacagcagctttgacagcagctgagcctacatcttgtgatggctattgtcactggaggttgtcaccgaggagcctggccagggtctttgcctctctccctccattccgccaactgaacactatggggcaaccgaaccacagtcaagaactgggctccacaacgagtaggctccccttagggcctccattctggttattcattgctgtgtaatgaaccacctcttcccaagccttagtggcttcaaacgacagtgtgttattctctctcccaactctgtgtgtgggttgactcagctcagctgggtggtttactcacttgagatctcttgggtgtttgcagtcagattgctctagggttggagtcatttgaaggcctgactgatctggaagtccaggatggctttctctctcacagctgctgggtggtgctggctgtcagccaatgctgttggctggaacaccttcatgtagcagggatcagaagatgcaggtcggtgaagggctatgctgggaactaacacagcatcactcctgccacattatatggtccaagtagtcactgggcacctggattgaaggctggtggagaaacagaccccatctcttcctggagagacatgtggaagggcacgtgggtgggaagtgccattggggccatctttgggaaatacactctgtcacagcctcagacattgaggtggggctctgccaagataaacagaagtttcccactttagcagagcactctctactcttcaaagagcttgcgtggccacgcccatcacgatttctgtgggggatgtggaccacagggcttgggaggcagtacagcagcgaaggccagagcactgctcttccaagatgacttaggaaaactctttcgcctctctaagccttggtttcctcatctgcaaaatgggtaataaggatgcctcgctttatagcttcattttgagaaataagagaggtattaactgtgggcacttggaatagtgtcaaagagaaagcaagcccatgtgagtggtgatgatgattattactcccccactgtatttatttctatctttaagatatgtaatttaattatttattttttaaggaatttttttttttttagatttttatttatttagatttttatttattttagatttttattcatgagagacacagagagaggtggagacgtaggaagagggaggagaagcagggtccatgcagagagcctgatgtgggacttgatccaggcatcctgggatcacgccctgagccgaaggcagatgcccaaccgcaggtgtccctgcaatttaattttttaaatagatgatatgctgaaatagttcatacatcaaaaaggaatatgtgagtccacagagcggagtctccctgcctggtatccagccacctgctttcttctcagggaggcagccactctttccaggtcctgtgtcctaccaaaataccctctccattttataagcaaacatgggtatatagtcttccaccaccattttctttctttttaaaaattcttttagaaagagagcgagagagagagagcaggggtaggagcaaagggggatggagagggagggggaaagaattgcaagcggactccatgctgagcgtggagctgacctgaggcccatcgcagtccccaatctcacgaccctgagatcatgacctgagccaaacccaagagttggaagctcactgactgagccacccaggttccccaagcacgcaagtcttgatctcggggtcgtgagttcaagccccacgttgggcatgaagcctacttaaaaaaaaaagaaaaaagaaaaaagaaaaaatccatttcattgtgtggttgtgccgtggtgcttctaatgcactccttgcggaagggcactttgctggtttgcagtagttagctctaactcactgtgctgtgatccatattcattgtgttggtgaggagaccaaggtttgagaggcaaaatgcacgcccccagcccaggccccaaggccaggtggtggcagaaccagatcagcttccagtcccctggctctgcaccctcatctcatcttggcttgggcctcctggctctgggatcggggtgggaggaaaaggcggtgggcagcatagaaggggacaggtggctggagcatgggggcggtgcacaggcaaatccatcagtgtggtctttttctctttcttggcctaacactggctgcatgctgaaagagaaccggttggatggaaaaccccagacctcagagtggaaagcagccaagcagagatcatgggccgcagggggtgtgttgcagcagcgagcctcatggcagagcccttacatgcgccttgttgtttcttcaggtagggtttgctttggaggaagtagaagctggaacacagtccccgggtggagaggaacccagtcctataattcaggagacctgggatcaagacccaggcctgtcactgactcatgggatccttgggccagtcacctagcctccctgggcctagaagttgggagcttgatctattggggcctctccagtaacaagatccaggttctggagccactgggaataggttccaacactaactcagtgttggaggctcagtcaaggcacccttgactggtctcattccctcattaaaattaccagatgtggtaagagtcgaatgagataatttatatgacagctcctggaaaattaaaaaatcaacacactgtttaaattcctctcccctaggtattcattttgaggctggtattacaaatggtgaactcgggcagcccgggggtggagggggtggggtggggtggggtggggtgggggggtgggggggtggctcagcgatttagcgctgccttcagcccagggtgtggtcctggagactcggaatcgagtctcacgtcaggctccctgaggggagcctgcttctccctctgcctgtgtctctgcctctctctctgtgtgtctctcatgaataacaaaaaaaaaaaaaaaaaaaaaaaaggtgaactctgcccattatcacatcttcaatgtaagattattagtgagccacatctctctgttgttcaggacacagaaattaaaaatcatagccaaggggcacctgggtggctcagttggttaagtgccatcagctagggccatgatcccagggttctgagatcaagccccttgtcgggctctctgttctacggggagcctgcttcttcctctccttctgcctgctgctcctcctgcttgtgttcgctttctctctctcaaataaataaacaaaatctttaaaaataaataaataaaaaccacaacacaaaatctttgtggggtgttgaacttgatacccagcatctgcttagacagtctacctgcattgaaggtacaatgccactaggtggcgatggtgtccagaccactgcggtgtgctctgagcacaaaccccaaggaccatctgggaagttctttttaatagttagagaggtctcactgaaggaccgggctcggcctgtttcctcatctgtataatggggatactagcactagatgagttcacgtaaaatcctcctgtgcacagaaagaccttcagtaagtgtttgcttctttcctagctaagtgacatgaatctggcttttagaaccagactgcctgggtttgaatcccagctctgttacttaccagctgtgtggccttgggcaagttacctaacctctctgggccttcattttccctgtctgtaaatggggctagtagtcatacctatccccatagttcatatgcttaaaatgcttagaaagcacctggtccaagaagagtgctctgagtttgccactgtctacatatgtcctagggcgaaccctctctcatgtatagtctaggtcttaaatttgggcacctcccaagattgagtaccttgtcaagacaataggtcttcaaggcatgagtcatggacagagaaagctacaattccaaaactcccgacaccctggtctctggattcagggtgcagctggcaacaaacagcctctgtccaccaggcaggtgacagaaaccaatttgcaagtgtgaagccagctggtgagaagataaggagagggcagaagggggctgtgaggctgtttttaaagtacttttgtccctctgggctttcttgctcacctccatgcatgctgttgggaggcagctcagaaaataaaacaccatgggctactgggccaatggctttccccgtcaggtcctgccccacctccatgcaaccttgcgggggaggtagaggcatctggtgacaacagcacctgaccagaagtcaagagatctgtttttagcccagctctgtcaccaatgtgctgtgtgaccttgacgagtcacttcctctctgggcttcagagtcctgctctgccaaaattgggacacactccctgttctacctttccaactagagatgtggtgagtgtagagaaactcctcaaaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcctcacttccctccatcacctgcctaatcaggtctgtttctctattcttctccccacaactgccctaactgggtccagtttctgtcgacctccagccccccagcctttcttatcctctgtattatgacccccaccccctgggggtgcctgtacccttcccactcttgccatcctccaccaaggctgccaagggaaactgagcatctttgatcagccagtgtcctgtgctctggacttcactacgttttcattttttttaaagattatttatttatttattcatgagagacacagagagagcaagagagagtcagagacacaggcagagggagaagcaggctccatgcagggagcctgacgtgggacttgatcctgggtctccaggatcaggccctgggctgaaagcggcgctaaaccgctgagccatgagggctgcccttcgctacgttttcaaaacatcccagtcctgggcatctacaccaaggctctgatgatgcactgggtaggcggatgtaggggaggggcaagtattgtagtctagccatagacttaaacagagtgtgcttaaacagctcatggggaattaacctcttcacactgagaaaattcttttctttttttttaagattttatttatttattcacgagacacacacacacacacacacagagagagagagagagaggcagagacacaggcagagggagaagcaggctccatgagggagcctgacatgggactcgatcccaggtccaggatcatgccctgggctgaagttagagccacctgggctgcccacacattgagaaaattctaacgagaattttgcagcgccatggagacccaaaggggagagatgtgggggtatgtatagttaatgataataatatatatgatttattacatacctattatgtttcaggcactaggctaggtgccttaaaccctttgtctaattccaaaaactctgtgaagcaagtgtcattatcatgatgataaaaacaacaaaattctctgagtacttaagtgctaagcaattcatctttattgtcttgtgtaacattcacatgacctgtgggacaggtgctgtggttgtctctttttccaaatgagggaattgaggcatagatcactgtagtaagttgtcacacagctattaaggaggctgaacctcagagggattcaacaatatgtccttttttacccagcaaacaaacaactgagtgaagtctgttttctcctccacaagctcaacacatttcctcctggcaatgggaaattccaggttgacagaaggcgactggggtggcaaagtgagatttcatcagctccagacatgagcacatcccttacatggagggggtccagcctgctctgggaccccagcccagccacctgccaaatgtctcctggctttgctgacctgtctcagtagtccttcattgcctctcgccccatctggttcagcagaatcccagcacacccattagaaggctgcctcctccaggaagcctttctggatggccctaaaccagagccctttgaccttctctgggacattgtccgctggctttggctgtccccgtcatccttggtgtaggtactgtcgtctggcctccctaactaggtgttgagttcctctaggctctaacacctaccatgcacccagtgctcagagaattccaattgaatgaataaactctgctcttcagccttcccctggatcactggggtcatgaattttggtgctatggtgaggatgggtgggagggggataacaggaaatatgtgtgaccagcccaggtgtacaacagagagtggtgaggtctgtggcaaaggagagtttggatgcctagtgaggggcttacagtcaaattcagccacccctactccccacaaacgtcccagatccaatcgccctgtgaacactctatctttccctttcactggctctatttttctactttgtgcctaccatcttaaaatatctctatcctatttattatattcaacatttgttttccctgacaaatgcgaactacctaagggcagagatttgctgttgtttcttttgttggggggagggggagggtgctgttttgtgtcgaataaatcatcagccccttgcacgtacctgcagcggagagagctgcccgagtcccccctgcaggctccaggctcccggacacactcggggttcaagtcaagaagagcgatgggccttcggggtcaccgcaagcctcccagggaaccccaaggagccggcctggagtctgtctccatgacagcaggtgcggcagacactaaggcacgagggttagtggctgccccttgagggtcagtggggcacctccgggagagcggctattggtgggggaggacgggggtgggtgggagaggaggggccgtcactcagggcgcgcgcaccccgtccacgcaccctctcgtcccagaagacgcagggtaggggaggccagcaaccgacagacggacggtcagacagggccaggggaatgtcccagaaggtgtggaagggcaacgaggggaggggagagtgcccccgcgggcgcgctcgcaggagggctgcggggaggaggcacgggggtgctcccggcacccgcccggccgccgcagagcaccccaggggcggccccgccgcagagcaccccaggggcggccccgccgcagagcaccgcagggggcggccgggacccggggagccgccccccgcccgggtgccgctaagccgggcgctgcctcctcagcgggcaccgcgccgccctgcgccgagccgccattggctcgctcgaaatgcctctctaatccgcgcggcgctgcacgcccccgctctgaccttcctcctccccgcagcccgcgctccggggagacgcggcggcggcgcagcttcctcttcccccgggcagtcgtccgggcttgaggccgccgcggacgcgcagctccgccctgcggcgcgcggagggtgccaggcgctgctgcccgcaggtaggggtcgggccccgggggcgggggcgggggcgggggcgggggcgtcacccgggcggtgccgggaggcccctgcgccgggccccgcgggcaggcagctggcggcggaggccttacccgggaagcgccgggcagcggggccttgggagcgggcacccgggcccggggatcccgaggctccggccgggccgggctgctcccgcggggtgggctcgtgcccgctgggtgcggcggctgttcatggaccagagtgggctgagagaagcgcagcagccgaggcgccctgtgctccgtgcgtccgccccttcccgcgtagctggcgggggaggggatgctacacagcctgcaaagacgccgaagccgaagccggggtcttcccggcgctcttcccgacgctcttccccatcccccaggccacttgctgcccgtcggaactacctctccgtcttctttttgccttaggagggcgtgaatgtattaaaaggtcatcagggtgtgagggccgcagtggcagaccccggagcttggccagacccggcctcaagccccacccaccccggccccaaaagccaagttttgcccccccggggaaggaacaaatggggccctttttttccggggaaacccaaaaatacccccctttccccgggttggggcccccccgggggccaaacaaaatttttttcccaggctttggggggtttgggcctttcccccccggcctttcccttaaaaggaaaatcagggttaaaaggttccgggcggccgggcccccccccccccccccccccaggatgcttcctgatgctccggtgaaatccctgcctgcctcctgccctgcattctcccacctagtcgccttgtggtttagttatttatggcgcgtctgtcaccctctagaccagaagtgccttcgggataggaatctgtttgattcatttctgtcattgactgtgcgcctggccagggtctggcaccaagtaaatgtttgtggaatgagtgaatgaatgggtttgaagtatgggagatagctggcaacctgcagatggggagtgagtctcctcttgagctttctttccatcccccggaaggagagccaccaaagtcagacagttcccttttggcccttcttggtcttgcagctgatggctactatggcatttggagataaatgtcacagtcccagtggctctaagagggtctttttgggctcctggtttgagtgccctggtctaagccaaacttggggaaggccccagtgaaggtctggcttaacctcatgcccttgagtgggcactttcctcttgggtgctcagctcagatcatgggaaagtcctggtcagcatcagggagtctgggaaggccccagccaggccatcctcagcttccagggtcctcatagagagctcagagcaaatctcatgactccatgtgtggaggaggaacccaggccagaagaagaagaagccaaaggtccaggggtctgcgacagatgtggaccttcagcaccttgttgctcctttgacagccatgctgataagacatctgcaatttgttcttgtcctggccttacagagggggagactgaggcccagggaagcttagcagcaagccaggggtggcacttaattcctgcctccaagtccagtgctttctccatggggccccagggagctagggtgaggccccgatgccaggtcagagtgtgatcgttgtagaaccagaagttcccagtctttggctctgtcttgacctctagtaatggaaagagtaagagaatatggaaggggtgcttcaggggtaagataatacgggaggggtgcttcagggatagggggagacaagtggaggatgagttagtcagtacctgcagggggttggccctggggggggtccccagaagagggtgcagtaacagcagtaaaaactaacaacacaaggcatttgtcatgtgccaggtcctgtcccaactataactcattcagtcctcaccgtagcttgaagtagataccattattattcctattttgagaaatgagactgaggcacagagaggttatctgtccaagatcacacagtttgaaagtggaggagctgggatttgaacctcagctcccaagtccaggctcttagcctgtattccctattgccagagcaagagggctatggagctgactgatgggggcttgctgtctccttggagacacgggtttcaggcactccatggctgaagttcacgcagggtgggtgcgatgtgcatggctgtgactgtgtgttggggctgctgagaataagaatccagtaagcagcaagtgtgaccttcataggatgcacacctgaccctgtatcagtcccctgctctacatccttcaatggctcttcactgccctgaggactaaaggcagtctccttaatgtggcacttttatcctccccaagtctgagtttcctccttctcttcaccctccctctgccttccagctgctctgaactgctctcagttcctcaagaaagtcatgcttctttcacctgctggcctgcgcacaggctcttcccccacgagaacactcttgtcctcttccctccacattccttctcaccctggagttggggtggctgagacttctgttcctcccagaagcttcccgacttgggcatcctgctcaccacccctcacgcggtgccctctggggcgttgggtttgttgccccatcttcccactgcaaggctgtgaagtccaaggagcgaggtctgtgctctgtccctggtgtctccagtgcctggcaccatgtagccctaggtcacttgtagaatgagtgagtacgtatgggtccctcacatcaccaacctcaggacacagaaagcatttttcttctccccacgggaattggggaaaccactcataaatttgcataacccccctactgtcccccaacaaggatgggctggtggtagaaagccctcactggagaagtgaaaccacctgtggacctggtggacaggtgggagaggtcagtgatctgcggaagagtcctccccagggggaacaggtggagggatggggtaggagtgagtgtgccagccaggtggaggagggatgcttggtttggtcttacacttttctgaagtttaaaaacaaaaaaacctcttattttcttatgaccaaaggaatatgtgcttgcggtggagaattgagaaagtactagaaagccaaacaaatccattagcctgtatgtgccacacccacctgatgtaggcacttggtggctggtttccagccaggggcagcagactagggcaggaaacgggcagtggcgggcaggggagggggggaatcgggggactggacacaggtggggtagaaagtggagggggagcattagcgggcaggtgggacagggaagggagcaggcaggacaggatgaagggagaagtgggcaaccccagggatccaggtgtgctctggagctagagtcaccttttttttttttttttaaagattttattttatttattcatgagagacacagagagaggcagagacacaggaagagggagaagcaggctccccgcagggaacccaattgcgggactcgatcccagaatcctgggatcaggagctggcccgaaggcagacacttggccactgagctacccaggcatccctggcgtcaccctttagagctgaacttggatctgtcaggcgtctagacctaagcagccagcaggcgctgggtagggggcagggttgcccttaggcaggtggctctatagtggcagcagtgcctggaggctgccacctgacagtcctgtgcccacatcacccccagcagccggggtgagaggtggtgtttacccccggaaaggacagatgcgttcctgcatgataggccaggggagaagatgagcaggaacctggcccccgctggctctgaggggatgggaacaccagtgtcagggaagttagtggggccatctccgggtgggggtgtactgtgggggtgggggtagttcctctggagacttctccgccgtgaggggcagcaggctgcctgatggctggtcaggcagaggaagcctcggctgctatttaaaaaacacttgatattaaaatgctgggtgggggctgcagtaggcttcgaggataaaatccaggatgcccagttaaattggacctccagataaacaacaaatttgtttagcgggagcctgtcctcaatattgcatgcaacatgcttgcactaagaattttatttgttgcttatctgaaagtcacatttaagtaggtgtccttgggatccctgggtggcgcagcggtttagcgcctgcctctggcccagggcacgatcctggagacccgggatcgaatcccacgtcgggctcccggtgcatggagcctgcttctccctctgcctgtgtctctgcctctctctctctctgtgtgtgactatcataaataaataaaaaattaaaaaaaataagtaggtgtcctttattttaagttgctaaatctggagggggagggggcagtgtagaggttctaattctctcttcttttgtattgtgggaggggtcagtggatacttgcttagagttgacagttaaaaaaaattaacatgtccatcttttttttttaaagattttatttatttattcatagacacagagagagagaggcagagatacaggcagagggagagggagaagcaggctccatgcaggaagcccgatgtgggactcgatccagggtctccaggatcacaccccaggctgcaggcagcgccaaaccgctgcgccaccagggctgcccaacatgtccatctttgaagtcaatgaaatatttcaaattttgcgtatgtaacctgtttgttgtctagagaatgatgccttacttgtggatttgggttccctagggccattcagaaatgataaaggatacatcctctcatttattcaagagggacaggaaatttgaggatccagggtggagtccctaaagaatgttaattcattcaagaaatagatatctgtatcataagaaagctcttatgtggcagagggtgtgacaaactggaactccctgtcagccgggagggtaggttggcactgcctttctggcaatagtgatcaaagcattgacctggtagtttctttcacaggttccagggtgcagagacagctgggtggaaatggtcagtgcagcagagctacatgcccaacgggagggacagagttaggacctctccagccagtgggatttttcaattagcaataatcgcgccttggataaacctcattggctacgatactgccactgcgcaaagctcagcgagtgggattttgagcagctgttcaattatttcatttggtcagtgaatctccactgcatgtctcctgtgtgccaggcactgttttagatactttagggatgctgagagagaagaacagatggtcagaatgtatgggcaagtgaaggcaagtgactttgtgggatgatgtatttcgtatgatcccattttaaaaatgtacacatgtatctgtgtgttcctattgcataaacatgttcagaagactagactgcatactcaggtgttttttgagctgacctctggggacaggtaacaggaggctccgtgccaggcaggacgggaatatttcctttttctttcggccagcctgtgctgtttaaattttatttattttatatattttttaagattttatttatttgtttgaaagatggggagagagggacagagtgggagagagaatgaggggggtttggggtaggcagagggagagggagaagcagactctctgctgatgtggggctccatccccggactttgggatcatgacctgagccaaaggcaggcacctaaccgcttaaccatctgagccacccagcatcctgctgtttgcattttatagaacgaatatcattcctcataaaaacataattaatattatgcttgataatatctgggattcttcttaggaatctaaaaaagtgagcatttagggcagccccagtggctcagcggtttagcgccaccttcagcctggggcgtgatcctggagacctaggatcgagtcccacatcgggctccctgcatggagcctgcttctccctctgcctgtgtctctggctctctctccttctgtgtctctcatgaataaataaataaataaataaataatattttttttaaaaaagtgagcatttaaattgcattccccttagtttgatggcatcggagtcagatgggcttacatttttatttgtggctagttttgaactggtccctgcatgggtgtctttctcttctctttcttcacgtcctcattgcgagtggatgagacccggtgggtgggcatgtgggtaaggtaagtctgggtaccaggaaggcagaaggagcatcgtagaagccaagtctccatgaaagtggtgattgggcacccgcagcgggtaagctgtcttggcagggggcaggggacatgaaggtgggaggtgggccctggacagcaatgccagggggcccaaggggcccaaggggcgggggcctgaggtccactgacgtgtggcaggcactgttttgtttatccatactgatgaactcatttagttttcctcagtcaccttacaaggtcatccccattttacagatgtggaaaataaggttaagtgacttgcctgagctcacagtgcaagtggctgaggcaggattcacacccatgtgatctggatccagagagactttgctcttttttaattctttttaaaagattttatttatttatttgaatggggggaggaggggcagagggagagggagagagaatcctaagcagacacctctctgagcacagagcctgagtcgggactggatcccaggacaatgagatcatgatctgagctgaaaccaagaattggatgcttcaccgactgagccacccaggcacccccagaggctctgctcttaacttctatgccacggctcgtcttgttagggagagaagataggcatgctcctgaagactgagggtgcttggccatggaaggtcttctgcaggaggtagatctggaagggaaggatggtagattcagagaggtggaaggtgccttccaggcaaagtgacagcagggacagagatgtagaggagcacgggagctggttgtatgtaggggctggggaggaaatgagcacaggaatctgagggaggaagtgagagtagaggctagtggagcatgtggcaaatattttaaaccattggcctcattggactctctggaacagatggcccaacccctcagccctcttctgctctgcttggtcctccccaggggcgaggtaccctattcctcacctgcctgggtctagccttgactgaccactggaggacaagagagacagctgaggcaggggaggagcaggggcttgggagcagggggacgagggggtggtacagacgaggtgctggccctcacacccactcgtggagggaccttgggccattcagcatctttcctgggactcagttccctctcctgttctttatttttaagctttctattatggcaaaatataagcatttccagaagtagagagaataggatagtgtaccactatgtatccattgctcagcttcaactcatggccagtttcatgtcatttctgcccccttccccaattcagaccaaatcccagacgtcatttcatcacgaatacatcaagatgtgtctcaaaacaataaggacttctgacataatcgcaatgccgttattccacctgagaagaaacgattcctttttattgtcacatacccaccgagtgttcatgtccccagttgttacaaacatgtctttgttttgtttttatgcttagtttgactcaggatccaaataaggccacatactttgattggttgatatgtatctaagtctctcttgatctgtggtttccctcttcatcatttcttctgtcctcgacagttgatctactggagaaaccagcttgtttgtcctgcagaatttcctgtagtctggattttgttgattgcatccctgatccctgtggtgtagtttaacatgtccctctgtcccctggcaggggactaaattgggtagttgggtgcatctgtcttcggactcctcatcatccagtcatcagtaaaccctcctgactttaccttcatgacgcccagaatctgaccacctctcaccacgtccattgctacccccgacccccacttctgagtctccactctagcttccctgcattattgcagtagcctcaacctggtcttccggcctccctccttgtcctagcagccaaagagacccttttaaaacctaaatcaggggcacctaggtggctcagcagttgagtggtcctgggatcgagtcacacaggggaagcccacttctcataataaaatcttaaaaaaaaaaaaatccgatcccatccctcctttgcccaaaatttcaatgacttcttcttctttggaataaaactcaaagttctataaaaagtcctgtaacagcctacaagctcctgtgtgatctggctgcgtagtacctctaaccgcctcgcaccattccttcctcactgggatgaggatgtattggataccctcttgcctcagggcctttgcactgttactccctgtgcctggctggtcagcatggctcgtgatgttcacattcctacccatgtcacctctttggagaggccttcccagagcatctcatctaaaatagcggcccttgcacccccgcccaggctttagcttccttcctggcatttgcccatccttggtgttaaaatattgttgctttcccctctttttcccctacccgcctgtgtgctcccaagagggcagggcagcatgactgcccatagaccaggcttcctctcccacttgcgtggctccagtcagctcctctcttttcagcatttcctggaaaataaaacaatgcttcagagtttataaaatacttcctgtcctaggtcagataccaggaaatctgacctaagacaaggattcctgggcaagtgatttactgcaggcatgctcacagagcggagggagggtatctgcccggcagggcagggaaggtgtgctgcggggcgcttgagagggggctggggctggggctgtcctgcctgggggcaaggggccaggcctctctacccctttagcaggcaatcattggggggaaggcatcacctcccaggcgtcttgagtgaggctgctcacctagaaacctggggagactctcaggagaaggggccgcagtacagggtatctggcacccctcctccactttctttgtatccgattgctgccctgagcccagccatcaactgccaggaggtatttatttatttattcttttttttaaaaaaagattttatttacttatttgagagagagagcgcgcgctagcataagtgggggaagacagggagaagcaggctccccatggagcagggagccggacgtgggacttggtcccaggaccccgtgatcatgacctgagccgaaggcagatgcttcaccgactgagcctcccaggggccagagggaggtatttattaatgaccacttttcctgtgtgataggtgaagaagcccaggtttgggggcaggatggtggaatgactggcctggggtggcatagccaggtaggcacagacctgggatgtgcatgcagattcttccttgggaccctctagtggctgctggttcttgatattcctcttgatgaagttttggaatataggtgaggtttggtggggtgaggtctggagccgaaaaccaagaaagaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttatcagggattttggaagcaaggttccctggcccttgagggggccagctgttgatgggaaaaggtcacttattaccatctaataaaacccgaggggcagcccggattgcttagcagtttagcaccaccttcagcccaggacatgatcctggagatcagggatcaagtcccacgtcgggctccctgcatggggcctgcttctccttctacctgtgtctctgcctctctctgtgtgtctctcatgaataaataaataaaatcttaaaaaaaacacaaaacctgagtcatgagaccttcagatatgtttgggtgggccaggtgcatgggggatggttgccaacatgtatcttgggggtttatttttatttatttatttttaaagattttatttattcatgagacacacacagagaaagacagagagagagagagagagagagagagagagagagaatgagagaggcagagacacaggcagagggagaagcaggccccatgcagggaacccaatgtgggacttgaccccaggtctccaggatcaggtcctaggctgaaggcggtgctaaaccgttgagccacccgggctgcccctaggggtttagagataaaggaatttttatatgtttaacatataaaaatatatcctgtaggcttacaggatcctgggggtcgggctgagattggcttcagtccttagcaaagtatgaacatcgaggcagctgagtccatagaggaaggtccctttgactgtttcaaggacttgtcaatgtgctgccccaggcttgtgctttgtccttagctagctgtctgttccctatcactctcattcattcagcaaataggtatccagtactgggtgccatattgacctgagtgctggccatttgtggcgagtgagcccccttcctgtctggggatgggtctatctacaccctttttaccccagaggagccctaagttccaatttccagaatgaaaacatgtgacaactgtcgagtccttgttgtatgctgggcactgtgctagactcctcttgtggaataacatgcctgagcttcacagcaccccatgcagaggggcatgaggctcaggctgcagaggggcttaaggttttgggccagggtctccagcaaatgtgtgatagaactgggattcacactaggtctgaacatggctttccccgcatccacctcccctccccggccccacccacagcacgctatctggtgtcacctctatcagcagctccatcggagaccaggctgctaccctctcctgctccccgagtgttgggtgaccacttgccatctcacctgccccacttggacaggccccagatagggcacctctgatgggtgctctcccccaccctactgggccctggattcttgcccccgcctacgcccccagtccctttgtcacggccctgactggctgggtgggcccttgggccagccccaagtggcctgagcattggggccccctcccacttgcaccaactggcctggtaagctgcaaagctggcttggcctgggtgtccctggacagggctgggggtgggtggcaaatcacaacgtaagggttcgttctcattactcccaaacaggtcaagacaagatcnnnnnnnnnnnnnnnnnnnnnnnnnctggctgccttggtgatggggatctgtgagtcatgagaatggggatggggcccccaacatcagcatcagctcctgattcctgagacccccactctccctagggcgctttgctgtccagtctccagctgctgtggactattgctcagttgagctgggtgctggaggccaggctctttcctcaggcctcgagactccctccagggactgcaccagaaggggtctatgccccccctggcaaaaactccaggaatatttgtgcatattctagacatgaaatagcaggcaaagcacatgcaaaaaagcccaccaccctgttggtgtggctaatggggcagttactatgcttacagcctggcctggatggctggagtgctctggtctgcagggaagtgaggtgctcacagcagccacagggatgcaggggaggtgggagccccgagagctgtagccaccccacccttactgcaagttaacgtctgatttccatcatagtttcctcctcaccagatggtgattttctaatttgatcattttgtttgcattagctagacttctgtaaagaactttcccccttcgttctgaaatatggtatgtatagtagaataaaggcttgcttctttccctttatcagtttcaaaataaatgagttggtgctctagcaacctccaatggtgaccagtgagtatttttcccattttaaaatacaaaagtgtataaaataggttatgcattgtaacaaataaatacaaagccaacatccaagtcactaaccctggaggtctaaccagagaattgctatagttgcaaaaggccccctttgcatcctttttccttattgggcctcccagagggacccattgttctaaatagtgttattagctgctttgtttttggttttaccacctaagtatgcatccagaatcaaatagttctgtctttgaattttaattaataaaattactatcctttcatggctagttttttttttttttcaattagtatttgcattttctttttaccatgcatctggagtgttctttgtagcagtgattctttcatcgttttcgccattgtatagcattttagtatgtgaatagactgtgatttagttacccaggctagcattcacatgcgtcagggtggtttctgatttgtggctattgtgaaaaatgccaccctgaacattctctaaataaacacactctgtgtttctgtgggttacatgcctaggagtggaattgctgggtcacagggtatgtgtgtcttcacacttactggataatgctaaactgttatcccaagtggtcgtaccagtccacacgagtacaggccgcgtgcactgcatccagtgctctacattctcgcagaccttggggtattagcagacttttaaagtttttttagattttaatttttattatcactatgggtttttatcagtttgatgagtttcagtcctgtattcactacattgtcctacccttggccagtgggagcctcttcaacttgtctctggcatccttttcacacatgtgcactggtatttggaaatatccttgctttctggaatgcagatgttctaggcttctcagagctgccatcagccatttcttcaagaagctctgggtcattttatatatgtttttttaaaaattgggatataattttataccataatttcccttttaaaatgtacaattcggtggctttttgcacattcatgaagttgtgtacttttagaagttgccactgtctagttccagaacatttccatcactccagaaagaaaccccatgcacttgagcacctactcctccaggtctccttcccgaagctcctggcaaacaccaggctactctgtctctataaatttgcctcttctggataattcttttatggccagtggactcatatgagacttttcttcttttttttaaagatctctcttatttatttatttatttatttatttattatttttttaaaaagattttatctatttattcatgagagacacagagaggcagagacacaagcagagggagaagcaggctctgggagcagagcctgatgtgggagcctgatgtgagactcgatcctgggactccaggatcacaccctggactgaagacaggtgctaaactgctgagccacccaggtgtccctcatttatttatttgacagagagacagagcacatgagcaggggaaggggcagagggagagagaaagagaatcctcaagcaggctcccagctgagtgcagagccagatttggggctcaatcctgatcaattatgatcagggctccaagatcatgacctgagccacaggcagatgtttaaccgactgagccacgcaggtgcccctcatataagacttctctgactggcttctttcatttagagtactgtttttaagggtcatcttgtggtggcatggggcaggacttcattagttttttggttttttttttacttcattagtttttatgactgaataataatccattgtatggatatacacattttgtttatccatttatcccttaatggacatttgagttgtttctactttttggttgttatgaatgatgcctctatgagcatttatgtgcaagaggacatatgctttcatttctcttggatatatacccaggtaacatggtaaatgtacctttaactttctgaagcccaaccaggttgtttcccagatggtgctagttcacatttccgccagcagggtatgaaagttcatttctcctcatcctccccagcgctttggattatccatctttttttttttttaatttttttatttatttatgataggcacacagtgagagagagagaggcagagacacaggcagagggagaagcaggctccatgcactgggagcctgacgtgggatttgattctgggtctccaggatcgcgccctgggccaaaggcaggcgctaaaccgctgcgccacccagggatcccaggattatccatctttttgatcgtaaccttcctggagggtgtaaagtgacatcttattgtggttatgataggcattttccaatgactaatgatgttgaacatcttctcatgtgctttttatgtatcttctttggagaaatatctttttacttcctttcccaacttttaatcgggtactttattcattcattcattcattcattcactcattcatttttaaggattttatttatttattcatgagagacacagagagagacagagaagcagagacccaggcagagggaaaagcaggcttcatgcagggagccgacatgggactcaatcctgggtctccaggatcacaccctgggctgaaggcagcactaaactgctgagccacctgggctgcccctctctctttttattgttgaggtttttttagagttctttatatattctagatatgagacacttattaaatatatgacttgcaaatttttttcctcatttctgtgagttgttttttctttgtggattcacttatttttatttttattttatttatttttatgtattattattattattattattattattttaaatttatgataggcacatagtgagagagagagagaggcagagacacaggcagagggagaaggaggctccatgcactgggagcccgatgtgggactcgatcccgggtctccaggatcgcgccctgggccaaaggcaggcgccaaaccaatgcgccacccagggatcctttatttttatttttaaaaaagatttttaaaattattggagcacaggggaagagggagaagcagactccccagtgagcaggagcatggtgcagggctcaatcccagaaccctgagatcatgactcgagttgaaggtggatgcttaaccaactgagccacccatgcgcccctctctggatccatttaatgaggaatggtagttagagacttagtctgggtgttggaggcattatgctttttgaattctagaaatcaacctaagaacctacccagagcctcagaagctctgggcagtagggccttgggctgtagggagtagccttgcctgatccccttgctttacagggatattgagaagtagaggggggaggtggcttgcaggggcacccagtgctatgtggctaggggtcaccagacttaggtccccactgtagttcccattactcctcttaggatcctcatcctagcccaacctacatcctccaaacccctagactcagccattctctttacttcggtgcctccagctctgttttgtggctcttggcttctcttctttcaaggagaagcttctttggttgccccagcccagagggcttgtctgcgatgaactcctgtggccccaggaggtggaaggttgcattctccaatgcattggatgcattatcagtggtcaaatttgggagaaacgaggtacacccaaggtaaagagtttcctttatgcaggacttatcagtgcctttaacctatgtgtgtaacctattgtgaatgtcaaagtatgtaattgctgaaatttaggagtaaactaagacgtcctgtaataggtgaatggataaacaaactcgtatgtctagacaatggtatattaatcaggactcaaaagaagtgagccatcaagccacgaaagacatggagaatccttgaagaaattagtgagagaagccagtctgaaaaggctatatactttttgattccaactatatgacattctggaaaagacaaaacttacagagacaataaaaagatcatggttgccaagggtttggggagagggagaaagggttagagggataggataggtgaatgggtaggtggaacacaggagattttcagggcaatgaaatgatcatgtaggataccgtagcagtgggtgcatgtcactatatgtatgtcaaaatctacagaatgtacaacggcaagagagaatcctaacgtcatctatggactttggttggtgatgacaacactgttggttcattgactataacaaatgtgccatactgatgtgatagtggtggtaggggaaacgggggagtgggatatgtgggaattctctgtattttctgctcagttttgctatgaatctaaaactgctctaaaaataaagcctatgaattaaaaaaagtaacatcaaggagtaatgagtgttgcaaaggaaaagtaaaacagaagtagggggctagggagtgacaggctggcttttagatgggttaggggacagagacattagagacctaacagggcaaggaaatgagccttgtggacatcgggaagagtatcccagcacagggagggcacatgcaaaggccctagggcaggaaagagcctgatgtatatgaaggacaaagtgcctagaagggagaaggggatgggggagtggctagaggtgagggtaagcaaacaggctggggccctccatgttccacctacaggctgggaaagcccttggatcttgttctcagtgagatggtgagcgacaggagggctttgcaggagtatgggagtatgtgacatgtcaaaatcatatttatgatttaaagagaggagtatctggcaaataggtggtaaggctcaagggtggaagggagacctgctaggaggccacacagtcctccaagtgaggactccatcatatggtgctgacctactatctgtggcagaggaggtgtggagtagctggggattctggggatagttggagaggagagtccgtggatgtgggggcgagggaaggagaggaatccacttcgttgatttgagcacttgggtgaacagcgatgtcattttgggggat

(The sequence listing continues in the following parts.)

We claim:

1. A method for treating a canine subject for necrotizing meningoencephalitis (NME), comprising:
    extracting genomic DNA from a sample from the canine subject;
    assaying the genomic DNA for one or more single nucleotide polymorphisms (SNPs), wherein the one or more SNPs comprises BICF2P608380 corresponding to position 1575622 on SEQ ID NO: 1 and BICF2P178662 corresponding to position 453486 on SEQ ID NO: 1;
    detecting a G allele at BICF2P608380 and an A allele at BICF2P178662 in the genomic DNA from the sample; and
    administering an effective amount of an immunosuppressive treatment to the canine subject having the G allele at BICF2P608380 and the A allele at BICF2P178662, wherein the canine subject is selected from the group consisting of Pug, Chihuahua, and Maltese.

2. The method of claim 1, wherein the canine subject is Maltese.

3. The method of claim 1, further comprising assaying the genomic DNA for one or more SNPs selected from the group consisting of:
BICF2S23225431 corresponding to position 503997 on SEQ ID NO: 1,
BICF2P22942 corresponding to position 514107 on SEQ ID NO: 1,
BICF2P194998 corresponding to position 561837 on SEQ ID NO: 1,
rs8856588 corresponding to position 909317 on SEQ ID NO: 1,
BICF2P574765 corresponding to position 997440 on SEQ ID NO: 1,
BICF2P1186632 corresponding to position 1020913 on SEQ ID NO: 1,
BICF2P1185629 corresponding to position 1078280 on SEQ ID NO: 1,
BICF2P540937 corresponding to position 1116275 on SEQ ID NO: 1,
rs9189886 corresponding to position 1130200 on SEQ ID NO: 1,
rs9006653 corresponding to position 1202968 on SEQ ID NO: 1,
BICF2P1200278 corresponding to position 1217609 on SEQ ID NO: 1,
rs9125534 corresponding to position 1222157 on SEQ ID NO: 1,
BICF2S23322760 corresponding to position 1279134 on SEQ ID NO: 1,
rs8760645 corresponding to position 1311449 on SEQ ID NO: 1
rs9245050 corresponding to position 1315293 on SEQ ID NO: 1,
BICF2P863589 corresponding to position 1346458 on SEQ ID NO: 1,
BICF2P1115728 corresponding to position 1350853 on SEQ ID NO: 1,
BICF2P1254053 corresponding to position 1435821 on SEQ ID NO: 1,
BICF2P402427 corresponding to position 447223 on SEQ ID NO: 1,
rs8694179 corresponding to position 1450810 on SEQ ID NO: 1,
BICF2P459960 corresponding to position 1470715 on SEQ ID NO: 1,
BICF2S22951431 corresponding to position 1483921 on SEQ ID NO: 1,
BICF2P1261424 corresponding to position 1486888 on SEQ ID NO: 1,
rs9120943 corresponding to position 1505458 on SEQ ID NO: 1,
rs9077055 corresponding to position 1525153 on SEQ ID NO: 1,
rs8677516 corresponding to position 1543627 on SEQ ID NO: 1,
rs9132539 corresponding to position 1586067 on SEQ ID NO: 1,
BICF2P1340012 corresponding to position 1597885 on SEQ ID NO: 1,
BICF2P1211546 corresponding to position 1607518 on SEQ ID NO: 1,
BICF2P738783 corresponding to position 1628812 on SEQ ID NO: 1,
BICF2P1313789 corresponding to position 1940424 on SEQ ID NO: 1,
BICF2P639740 corresponding to position 1972696 on SEQ ID NO: 1,
BICF2P535495 corresponding to position 2080001 on SEQ ID NO: 1,
BICF2P1380652 corresponding to position 2095669 on SEQ ID NO: 1,
BICF2P1462329 corresponding to position 2118860 on SEQ ID NO: 1,
rs8957837 corresponding to position 4109204 on SEQ ID NO: 1, and
BICF2S23516667 corresponding to position 235408 on SEQ ID NO: 2.

4. The method of claim 3, further comprising administering the effective amount of the immunosuppressive treatment to the canine subject having at least one allele selected from the group consisting of:
a G allele at BICF2S23225431,
a G allele at BICF2P22942,
an A allele at BICF2P194998,
a C allele at rs8856588,
an A allele at BICF2P574765,
an A allele at BICF2P1186632,
a G allele at BICF2P1185629,
an A allele at BICF2P540937,
a G allele at rs9189886,
an A allele at rs9006653,
a G allele at BICF2P1200278,
an A allele at rs9125534,
an A allele at BICF2S23322760,
a T allele at rs8760645,
a G allele at rs9245050,
an A allele at BICF2P863589,
a C allele at BICF2P1115728,
a G allele at BICF2P1254053,
an A allele at BICF2P402427,
an A allele at rs8694179,
a G allele at BICF2P459960,
an A allele at BICF2S22951431,
a G allele at BICF2P1261424,
an A allele at rs9120943,
an A allele at rs9077055,
a G allele at rs8677516,
an A allele at rs9132539,
a C allele at BICF2P1340012,
an A allele at BICF2P1211546,
an A allele at BICF2P738783,
an A allele at BICF2P1313789,
a G allele at BICF2P639740,
an A allele at BICF2P535495,
an A allele at BICF2P1380652,
an A allele at BICF2P1462329,
a C allele at rs8957837, and
an A allele at BICF2S23516667.

5. The method of claim 1, wherein the assaying the genomic DNA comprises a method selected from the group consisting of Sanger sequencing, next generation sequencing, pyrosequencing, sequencing by ligation, sequencing by synthesis, single molecule sequencing, pooled and barcoded DNA sequencing, PCR, real-time PCR, quantitative PCR, microarray analysis of genomic DNA, restriction fragment length polymorphism analysis, allele specific ligation, and comparative genome hybridization.

6. A method for breeding a canine subject to reduce propensity to necrotizing menigoencephalitis (NME) in progeny resulting from the breeding, comprising:

extracting genomic DNA from a sample from the canine subject, wherein the canine subject is selected from the group consisting of Pug, Chihuahua, and Maltese;
assaying the genomic DNA for one or more single nucleotide polymorphisms (SNPs), wherein the one or more SNPs comprises BICF2P608380 corresponding to position 1575622 on SEQ ID NO: 1 and BICF2P178662 corresponding to position 453486 on SEQ ID NO: 1;
detecting an A allele at BICF2P608380 and a G allele at BICF2P178662 in the genomic DNA from the sample; and
breeding the canine subject with the A allele at BICF2P608380 and the G allele at BICF2P178662.

7. The method of claim 6, further comprising assaying the genomic DNA for one or more SNPs selected from the group consisting of:
BICF2S23225431 corresponding to position 503997 on SEQ ID NO: 1,
BICF2P22942 corresponding to position 514107 on SEQ ID NO: 1,
BICF2P194998 corresponding to position 561837 on SEQ ID NO: 1,
rs8856588 corresponding to position 909317 on SEQ ID NO: 1,
BICF2P574765 corresponding to position 997440 on SEQ ID NO: 1,
BICF2P1186632 corresponding to position 1020913 on SEQ ID NO: 1,
BICF2P1185629 corresponding to position 1078280 on SEQ ID NO: 1,
BICF2P540937 corresponding to position 1116275 on SEQ ID NO: 1,
rs9189886 corresponding to position 1130200 on SEQ ID NO: 1,
rs9006653 corresponding to position 1202968 on SEQ ID NO: 1,
BICF2P1200278 corresponding to position 1217609 on SEQ ID NO: 1,
rs9125534 corresponding to position 1222157 on SEQ ID NO: 1,
BICF2S23322760 corresponding to position 1279134 on SEQ ID NO: 1,
rs8760645 corresponding to position 1311449 on SEQ ID NO: 1
rs9245050 corresponding to position 1315293 on SEQ ID NO: 1,
BICF2P863589 corresponding to position 1346458 on SEQ ID NO: 1,
BICF2P1115728 corresponding to position 1350853 on SEQ ID NO: 1,
BICF2P1254053 corresponding to position 1435821 on SEQ ID NO: 1,
BICF2P402427 corresponding to position 447223 on SEQ ID NO: 1,
rs8694179 corresponding to position 1450810 on SEQ ID NO: 1,
BICF2P459960 corresponding to position 1470715 on SEQ ID NO: 1,
BICF2S22951431 corresponding to position 1483921 on SEQ ID NO: 1,
BICF2P1261424 corresponding to position 1486888 on SEQ ID NO: 1,
rs9120943 corresponding to position 1505458 on SEQ ID NO: 1,
rs9077055 corresponding to position 1525153 on SEQ ID NO: 1,
rs8677516 corresponding to position 1543627 on SEQ ID NO: 1,
rs9132539 corresponding to position 1586067 on SEQ ID NO: 1,
BICF2P1340012 corresponding to position 1597885 on SEQ ID NO: 1,
BICF2P1211546 corresponding to position 1607518 on SEQ ID NO: 1,
BICF2P738783 corresponding to position 1628812 on SEQ ID NO: 1,
BICF2P1313789 corresponding to position 1940424 on SEQ ID NO: 1,
BICF2P639740 corresponding to position 1972696 on SEQ ID NO: 1,
BICF2P535495 corresponding to position 2080001 on SEQ ID NO: 1,
BICF2P1380652 corresponding to position 2095669 on SEQ ID NO: 1,
BICF2P1462329 corresponding to position 2118860 on SEQ ID NO: 1,
rs8957837 corresponding to position 4109204 on SEQ ID NO: 1, and
BICF2S23516667 corresponding to position 235408 on SEQ ID NO: 2.

8. The method of claim 7, further comprising breeding the canine subject having at least one allele selected from the group consisting of:
an A allele at BICF2S23225431,
an A allele at BICF2P22942,
a T allele at BICF2P194998,
an A allele at rs8856588,
a G allele at BICF2P574765,
a G allele at BICF2P1186632,
an A allele at BICF2P1185629,
a G allele at BICF2P540937,
a C allele at rs9189886,
a G allele at rs9006653,
an A allele at BICF2P1200278,
a G allele at rs9125534,
a G allele at BICF2S23322760,
an A allele at rs8760645,
an A allele at rs9245050,
a G allele at BICF2P863589,
an A allele at BICF2P1115728,
an A allele at BICF2P1254053,
a C allele at BICF2P402427,
a G allele at rs8694179,
an A allele at BICF2P459960,
a C allele at BICF2S22951431,
an A allele at BICF2P1261424,
a G allele at rs9120943,
a G allele at rs9077055,
an A allele at rs8677516,
a G allele at rs9132539,
an A allele at BICF2P1340012,
a G allele at BICF2P1211546,
a C allele at BICF2P738783,
a G allele at BICF2P1313789,
an A allele at BICF2P639740,
a G allele at BICF2P535495,
a G allele at BICF2P1380652,
a G allele at BICF2P1462329,
a G allele at rs8957837, and
a G allele at BICF2S23516667.

9. The method of claim 6, wherein the assaying the genomic DNA comprises a method selected from the group consisting of Sanger sequencing, next generation sequencing, pyrosequencing, sequencing by ligation, sequencing by synthesis, single molecule sequencing, pooled and barcoded DNA sequencing, PCR, real-time PCR, quantitative PCR, microarray analysis of genomic DNA, restriction fragment length polymorphism analysis, allele specific ligation, and comparative genome hybridization.

* * * * *